US008383793B2

(12) United States Patent
Morris et al.

(10) Patent No.: US 8,383,793 B2
(45) Date of Patent: Feb. 26, 2013

(54) METHODS AND COMPOSITIONS FOR THE DIAGNOSIS AND TREATMENT OF CANCER RESISTANT TO ANAPLASTIC LYMPHOMA KINASE (ALK) KINASE INHIBITORS

(75) Inventors: Stephan W. Morris, Germantown, TN (US); Qin Jiang, Memphis, TN (US); Xiaoli Cui, Memphis, TN (US); Liquan Xue, Cordova, TN (US)

(73) Assignee: St. Jude Children's Research Hospital, Memphis, TN (US)

( * ) Notice: Subject to any disclaimer, the term of this patent is extended or adjusted under 35 U.S.C. 154(b) by 223 days.

(21) Appl. No.: 12/761,050

(22) Filed: Apr. 15, 2010

(65) Prior Publication Data

US 2011/0256546 A1    Oct. 20, 2011

(51) Int. Cl.
*C07H 21/04* (2006.01)
*C12N 15/00* (2006.01)
(52) U.S. Cl. ..................................... 536/23.1; 435/69.1
(58) Field of Classification Search .................. None
See application file for complete search history.

(56) References Cited

U.S. PATENT DOCUMENTS

| 2008/0051419 A1 | 2/2008 | Corbett et al. |
| 2008/0090776 A1 | 4/2008 | Mano et al. |
| 2008/0171769 A1 | 7/2008 | Gregor et al. |
| 2009/0099193 A1 | 4/2009 | Mano et al. |

FOREIGN PATENT DOCUMENTS

WO    WO2009103061    *   8/2009

OTHER PUBLICATIONS

Chen et al, Nature, 455: 791-795, Oct. 2008, IDS filed Apr. 15, 2010.*
George et al, Nature, 455: 975-978, Oct. 2008, IDS filed Apr. 15, 2010.*
Koivunen et al, Clin Can Res 14:4275-4283.*
Armitage, J., et al., "Non-Hodgkin's Lymphomas," *Cancer, Principle and Practice of Oncology*, Chapter 45.3, 6th edition, 2001, pp. 2256-2316.
Azam, M., et al., "Activation of tyrosine kinases by mutation of the gatekeeper threonine," *Nature Structural & Molecular Biology*, 2008, vol. 15(10), pp. 1109-1118.
Bikker, J., et al., "Kinase Domain Mutations in Cancer: Implications for Small Molecule Drug Design Strategies," *Journal of Medicinal Chemistry*, 2009, vol. 52(6), p. 1493-1509.
Bradeen, H., et al, "Comparison of imatinib mesylate, dasatinib (BMS-354825), and nilotinib (AMN107) in a N-ethyl-N-nitrosourea (ENU)-based mutagenesis screen: high efficacy of drug combinations," *Blood*, 2006, vol. 108(7), pp. 2332-2338.
Chen, Y., et al., "Oncogenic mutations of ALK kinase in neuroblastoma," *Nature*, 2008, vol. 455, pp. 971-975.
Choi, Y, et al., "EML4-ALK Mutations in Lung Cancer That Confer Resistance to ALK Inhibitors," *N Engl J Med*, 2010, vol. 363(18), pp. 1734-1739.

Christensen, J., et al., "Cytoreductive antitumor activity of PF-23410166, a novel inhibitor of anaplastic lymphoma kinase and c-Met, in experimental models of anaplastic large-cell lymphoma," *Mol Cancer Ther*, 2007, vol. 6(12), pp. 3314-3322.
Deininger, M., et al., "Specific Targeted Therapy of Chronic Myelogenous Leukemia with Imatinib," *Pharmacological Reviews*, 2003, vol. 55, pp. 401-423.
Engelman, J., et al., "Acquired resistance to tyrosine kinase inhibitors during cancer therapy," *Current Opinion in Genetics & Development*, 2008, vol. 18, pp. 73-79.
Fava, C., et al., "Development and targeted use of nilotinib in chronic myeloid leukemia," *Drug Design, Development and Therapy*, 2008, vol. 2, pp. 233-243.
Galion, A., et al., "Identification of NVP-TAE684, a potent, selective, and efficacious inhibitor of NPM-ALK," *PNAS*, 2007, vol. 104(1), pp. 270-275.
UniProt Accession No. D1MAM0, Full=Tyrosine-protein kinase receptor; EC=2.7.10.1, 2010, XP-002656286, two pages.
UniProt Accession No. DIMAM2, Full=Tyrosine-protein kinase receptor; EC=2.7.10.1, 2010, XP-002656288, two pages.
George, R., et al., "Activating mutations in ALK provide a therapeutic target in neuroblastoma," *Nature*, 2008, vol. 455, pp. 975-978.
Janoueix-Lerosey, et al., "Somatic and germline activating mutations of the ALK kinase receptor in neuroblastoma," *Nature*, 2008, vol. 455, pp. 967-971.
Kancha, R., et al., "Functional Analysis of Epidermal Growth Factor Receptor (EGFR) Mutations and Potential Implications for EGFR Targeted Therapy," *Clin Cancer Res*, 2009, vol. 15(2), pp. 460-467.
Kutok, J., et al., "Molecular Biology of Anaplastic Lymphoma Kinase-Positive Anaplastic Large-Cell Lymphoma," *Journal of Clinical Oncology*, 2002, vol. 20(17), pp. 3691-3702.
Kwak, E., et al., "Clinical activity observed in a phase I dose escalation trial of an oral c-met and ALK inhibitor, PF-02341066," *Journal of Clinical Oncology*, 2009, vol. 27(15S), Abstract 3509.
Lawrence, B., et al., "*TPM3-ALK* and *TPM4-ALK* Oncogenes in Inflammatory Myofibroblastic Tumors," *American Journal of Pathology*, 2000, vol. 157(2), pp. 377-384.
Li, R., et al., "Design and Synthesis of 5-Aryl-pyridone-carboxamides as Inhibitors of Anaplastic Lymphoma," *J. Med. Chem.*, 2006, vol. 49(3), pp. 1006-1015.

(Continued)

*Primary Examiner* — Lei Yao
(74) *Attorney, Agent, or Firm* — Ballard Spahr LLP

(57) ABSTRACT

Compositions and methods for the diagnosis and treatment of a cancer that is resistant to at least one anaplastic lymphoma kinase (ALK) kinase inhibitor are provided herein. The present invention is based on the discovery of mutations within ALK that confer resistance to at least one ALK kinase inhibitor. Polynucleotides and polypeptides having at least one ALK inhibitor resistance mutation are provided and find use in methods and compositions useful in the diagnosis, prognosis, and/or treatment of diseases associated with aberrant ALK activity, more particularly, those that are resistant to at least one ALK kinase inhibitors. Methods and compositions are also provided for the identification of agents that can inhibit the kinase activity and/or reduce the expression level of the ALK resistance mutants.

6 Claims, 1 Drawing Sheet

OTHER PUBLICATIONS

McDermott, U., et al., "Genomic Alterations of Anaplastic Lymphoma Kinase May Sensitize Tumors to Anaplastic Lymphoma Kinase Inhibitors," *Cancer Res.*, 2008, vol. 68(9), pp. 3389-3395.

Morris, S., et al., "Fusion of a Kinase Gene, *ALK*, to a Nucleolar Protein Gene, *NPM*, in Non-Hodgkin's Lymphoma," *Science*, 1994, vol. 263, pp. 1281-1284.

Morris, S., et al., "*ALK*, the chromosome 2 gene locus altered by the t(2;5) in non-Hodgkin's lymphoma, encodes a novel neural receptor tyrosine kinase that is highly related to leukocyte tyrosine kinase (LTK)," *Oncogene*, 1997, vol. 14, pp. 2175-2188.

Mossé, Y., et al., "Identification of ALK as a major familial neuroblastoma predisposition gene," *Nature*, 2008, vol. 455, pp. 930-936.

O'Hare, T., et al., In vitro Activity of Bcr-Abl inhibitors AMN107 and BMS-354825 against Clinically Relevant Imatinib-Resistant Abl Kinase Domain Mutants, *Cancer Res.*, 2005, vol. 65(11), pp. 4500-4505.

O'Hare, T., et al., "Bcr-Abl kinase domain mutations, drug resistance, and the road to a cure for chronic myeloid leukemia," *Blood*, 2007, vol. 110(7), pp. 2242-2249.

Piva, R., et al., "Functional validation of the anaplastic lymphoma kinase signature identifies *CEBPB* and *BCL2A1* as critical target genes," *The Journal of Clinical Investigation*, 2006, vol. 116(12), pp. 3171-3182.

Quintás-Cardama, A., et al., "Flying under the radar: the new wave of BCR—ABL inhibitors," *Nature Reviews Drug Discovery*, 2007, vol. 6, pp. 834-848.

Ray, A., et al., "Identification of BCR-ABL point mutations conferring resistance to the Abl kinase inhibitor AMN107 (nilotinib) by a random mutagenesis study," *Blood*, 2007, vol. 109(11), pp. 5011-5015.

Sasaki, T., et al., "The Neuroblastoma-Associated F1174L ALK Mutation Causes Resistance to an ALK Kinase Inhibitor in ALK-Translocated Cancers," *Cancer Res*, 2010, vol. 70(24), pp. 10038-10043.

Shaw, A., et al., "Clinicopathologic features of EML-4-ALK mutant lung cancer," *Journal of Clinical Oncology*, 2009, vol. 27(15S), Abstract 11021.

Von Bubnoff, N., et al., "A cell-based screen for resistant of Bcr-Abl-positive leukemia identifies the mutation pattern for PD166326, an alternative Abl kinase inhibitor," *Blood*, 2005, vol. 105(4), pp. 1652-1659.

Von Bubnoff, N., et al., "A Cell-Based Screening Strategy that Predicts Mutations in Oncogenic Tyrosine Kinases," *Cell Cycle*, 2005, vol. 4(3), pp. 400-406.

Von Bubnoff, N., et al., "Bcr-Abl resistance screening predicts a limited spectrum of point mutations to be associated with clinical resistance to the Abl kinase inhibitor nilotinib (AMN107)," *Blood*, 2006, vol. 108(4), pp. 1328-1333.

Von Bubnoff, N., et al., "FMS-Like Tyrosine Kinase 3-Internal Tandem Duplication Tyrosine Kinase Inhibitors Display a Nonoverlapping Profile of Resistance Mutations in vitro," *Cancer Res.*, 2009, vol. 69(7), pp. 3032-3041.

Wan, W, et al., "Anaplastic lymphoma kinase activity is essential for the proliferation and survival of anaplastic large-cell lymphoma cells," *Blood*, 2006, vol. 107(4), pp. 1617-1623.

Weisberg, E., et al., "Second generation inhibitors of BCR-ABL for the treatment of imatinib-resistant chronic myeloid leukaemia," *Nature Reviews Cancer*, 2007, vol. 7, pp. 345-356.

Zou, H., et al., "An Orally Available Small-Molecule Inhibitor of c-Met, PF-2341066, Exhibits Cytoreductive Antitumor Efficacy through Antiproliferative and Antiangiogenic Mechanisms," *Cancer Res* 2007, vol. 67(9), pp. 4408-4417.

Hanks, S.K., et al., "The Protein Kinase Family: Conserved Features and Deduced Phylogeny of the Catalytic Domains," *Science*, 1988, pp. 42-52, vol. 241.

Lu, L., et al., "ALK Mutants in the Kinase Domain Exhibit Altered Kinase Activity and Differential Sensitivity to Small Molecule ALK Inhibitors," *Biochemistry*, 2009, pp. 3600-3609, vol. 48.

Webb, T.R., et al., "Anaplastic Lymphoma Kinase: Role in Cancer Pathogenesis and Small-Molecular Inhibitor Development for Therapy," *Exper Rev. Anticancer Ther.*, 2009, pp. 331-356, vol. 9(3).

\* cited by examiner

METHODS AND COMPOSITIONS FOR THE DIAGNOSIS AND TREATMENT OF CANCER RESISTANT TO ANAPLASTIC LYMPHOMA KINASE (ALK) KINASE INHIBITORS

FEDERALLY SPONSORED RESEARCH OR DEVELOPMENT

This invention was made with United States Government support under grant number CA69129 awarded by the National Cancer Institute, a division of the National Institutes of Health. The United States Government has certain rights in the invention.

REFERENCE TO A SEQUENCE LISTING SUBMITTED AS A TEXT FILE VIA EFS-WEB

The official copy of the sequence listing is submitted electronically via EFS-Web as an ASCII formatted sequence listing with a file named 382741SEQLIST.TXT, created on Apr. 14, 2010, and having a size of 951 kilobytes and is filed concurrently with the specification. The sequence listing contained in this ASCII formatted document is part of the specification and is herein incorporated by reference in its entirety.

FIELD OF THE INVENTION

The present invention relates generally to the detection and treatment of cancers that are resistant to anaplastic lymphoma kinase (ALK) kinase inhibitors.

BACKGROUND OF THE INVENTION

Anaplastic lymphoma kinase (ALK) is a receptor tyrosine kinase (RTK) in the insulin receptor superfamily initially identified in one of its constitutively activated oncogenic fusion forms—nucleophosmin (NPM)-ALK—in anaplastic large-cell lymphomas (Morris et al. (1994) *Science* 263: 1281-1284; Morris et al. (1997) *Oncogene* 14:2175-2188). Subsequent studies have identified ALK fusions in subsets of diffuse large B-cell lymphomas, malignant histiocytosis, inflammatory myofibroblastic tumor sarcomas, esophageal squamous cell carcinomas, breast cancers, colorectal carcinomas, and non-small cell lung carcinomas (reviewed in Webb et al. (2009) *Expert Rev Anticancer Ther* 9:331-356). Most recently, genomic DNA amplification and protein overexpression, as well as activating point mutations, of ALK have been shown to cause neuroblastomas (Webb et al. (2009) *Expert Rev Anticancer Ther* 9:331-356; George et al. (2008) *Nature* 455:975-979). In addition to these cancers for which a causative role for aberrant ALK activity is well validated, more circumstantial links implicate ALK in the genesis of yet other malignancies, such as glioblastoma, via a mechanism of receptor activation involving autocrine and/or paracrine growth loops with the reported ALK ligands, pleiotrophin and midkine (Webb et al. (2009) *Expert Rev Anticancer Ther* 9:331-356).

The involvement of mutant, constitutively activated forms of ALK in this broad spectrum of cancers has engendered considerable interest among pharmaceutical and biotech firms in the development of ALK inhibitors analogous to the small-molecule kinase inhibitors imatinib (Gleevec, Novartis) and erlotinib (Tarceva, Genentech/OSI) that target the Abelson (ABL) kinase and the epidermal growth factor receptor (EGFR) kinase, respectively. Since 2001, eight ATP-competitive small-molecule kinase inhibitors (including imatinib and erlotinib) have been approved for various cancer indications in the United States (reviewed in Webb et al. (2009) *Expert Rev Anticancer Ther* 9:331-356). Although these drugs have proven extremely valuable as anticancer agents—perhaps best exemplified by the therapeutic benefit realized in patients with chronic myeloid leukemia (CML) and gastrointestinal stromal tumors (GIST) following administration of imatinib mesylate (Gleevec, Novartis), the use of these inhibitors in the clinic has led to the emergence of drug-resistant tumors (O'Hare et al. (2007) *Blood* 110:2242-2249; Engelman and Settleman (2008) *Curr Opin Genet Dev* 18:1-7; Bikker et al. (2009) *J Med Chem* 52:1493-1509). This resistance has been attributed to a number of mechanisms including the amplification of the gene encoding the oncogenic kinase as well as the activation of alternative signaling pathways; however, the most common mechanism mediating ATP-competitive kinase inhibitor resistance is the development of individual or groups of mutations within or near the kinase catalytic domains of the kinase targets (O'Hare et al. (2007) *Blood* 110:2242-2249; Engelman and Settleman (2008) *Curr Opin Genet Dev* 18:1-7; Bikker et al. (2009) *J Med Chem* 52:1493-1509). These mutations preclude high-affinity interactions of the inhibitors with their kinase targets while leaving ATP binding by their catalytic domains intact. The emergence of clinical resistance to kinase inhibitors and identification of the kinase domain mutations that confer such resistance have engendered the design and development of follow-on drugs to treat patients whose tumors no longer respond to therapy with first-generation agents Robust diagnostic assays to detect the presence of resistance mutations in the ALK kinase domain are needed for clinical application to confirm the mechanism of resistance in cancer patients who become resistant to therapy with ALK kinase inhibitors, and to permit the informed selection by physicians of second-generation inhibitors for the management of patients with first-generation inhibitor-resistant tumors. No assays for the detection of ALK inhibitor resistance currently exist. The identification of these mutations will also serve to guide the informed design and synthesis of second- and later-generation inhibitors of ALK developed to inhibit these mutant forms of ALK that are resistant to first-generation inhibitors.

BRIEF SUMMARY OF THE INVENTION

Compositions and methods for the identification, prognosis, diagnosis, and treatment of cancers that are resistant to or are genetically predisposed to be resistant to ALK kinase inhibitors are provided. The present invention is based on the discovery of novel mutations in ALK that confer resistance to ALK kinase inhibitors, such as PF-0234166. Polypeptides comprising the ALK inhibitor-resistance mutations and polynucleotides encoding the same are provided and find use as biomarkers for use in methods for detecting the resistance mutations and in diagnosing those cancers that are resistant or likely to develop resistance to ALK kinase inhibitors. Antibodies that specifically bind ALK polypeptides comprising the disclosed resistance mutations, kits comprising the antibodies, and kits comprising polynucleotide(s) capable of specifically detecting or specifically amplifying a polynucleotide encoding an ALK having an ALK inhibitor resistance mutation are also provided herein for the detection of the resistance mutations in biological samples. Further provided are methods for identifying agents that specifically bind to and/or inhibit the activity of ALK or ALK oncogenic fusion proteins comprising the resistance mutations.

The following embodiments are encompassed by the present invention:

1. An isolated polynucleotide comprising a nucleotide sequence selected from the group consisting of:
   a) the nucleotide sequence set forth in SEQ ID NO:5, 7, 9, 11, 13, 15, 17, 19, 21, 25, 27, 29, 31, 98, 100, or 102;
   b) a nucleotide sequence encoding the amino acid sequence set forth in SEQ ID NO:6, 8, 10, 12, 14, 16, 18, 20, 22, 26, 28, 30, 32, 99, 101, or 103;
   c) a nucleotide sequence having at least 90% sequence identity to SEQ ID NO:5 or a nucleotide sequence encoding an amino acid sequence having at least 90% sequence identity to SEQ ID NO:6, wherein the polynucleotide encodes a polypeptide having a serine residue at the position corresponding to amino acid residue position 1123 of SEQ ID NO:2, and wherein the polynucleotide encodes a polypeptide having kinase activity that is resistant to at least one anaplastic lymphoma kinase (ALK) small-molecule kinase inhibitor;
   d) a nucleotide sequence having at least 90% sequence identity to SEQ ID NO:7 or a nucleotide sequence encoding an amino acid sequence having at least 90% sequence identity to SEQ ID NO:8, wherein the polynucleotide encodes a polypeptide having an alanine residue at the position corresponding to amino acid residue position 1123 of SEQ ID NO:2, and wherein the polynucleotide encodes a polypeptide having kinase activity that is resistant to at least one ALK small-molecule kinase inhibitor;
   e) a nucleotide sequence having at least 90% sequence identity to SEQ ID NO:9 or a nucleotide sequence encoding an amino acid sequence having at least 90% sequence identity to SEQ ID NO:10, wherein the polynucleotide encodes a polypeptide having a valine residue thereof at the position corresponding to amino acid residue position 1129 of SEQ ID NO:2, and wherein the polynucleotide encodes a polypeptide having kinase activity that is resistant to at least one ALK small-molecule kinase inhibitor;
   f) a nucleotide sequence having at least 90% sequence identity to SEQ ID NO:11 or a nucleotide sequence encoding an amino acid sequence having at least 90% sequence identity to SEQ ID NO:12, wherein the polynucleotide encodes a polypeptide having a lysine residue at the position corresponding to amino acid residue position 1132 of SEQ ID NO:2, and wherein the polynucleotide encodes a polypeptide having kinase activity that is resistant to at least one ALK small-molecule kinase inhibitor;
   g) a nucleotide sequence having at least 90% sequence identity to SEQ ID NO:13 or a nucleotide sequence encoding an amino acid sequence having at least 90% sequence identity to SEQ ID NO:14, wherein the polynucleotide encodes a polypeptide having a methionine residue at the position corresponding to amino acid residue position 1151 of SEQ ID NO:2, and wherein the polynucleotide encodes a polypeptide having kinase activity that is resistant to at least one ALK small-molecule kinase inhibitor;
   h) a nucleotide sequence having at least 90% sequence identity to SEQ ID NO:15 or a nucleotide sequence encoding an amino acid sequence having at least 90% sequence identity to SEQ ID NO:16, wherein the polynucleotide encodes a polypeptide having a tyrosine residue at the position corresponding to amino acid residue position 1156 of SEQ ID NO:2, and wherein the polynucleotide encodes a polypeptide having kinase activity that is resistant to at least one ALK small-molecule kinase inhibitor;
   i) a nucleotide sequence having at least 90% sequence identity to SEQ ID NO:17 or a nucleotide sequence encoding an amino acid sequence having at least 90% sequence identity to SEQ ID NO:18, wherein the polynucleotide encodes a polypeptide having a cysteine residue at the position corresponding to amino acid residue position 1174 of SEQ ID NO:2, and wherein the polynucleotide encodes a polypeptide having kinase activity that is resistant to at least one ALK small-molecule kinase inhibitor;
   j) a nucleotide sequence having at least 90% sequence identity to SEQ ID NO:19 or a nucleotide sequence encoding an amino acid sequence having at least 90% sequence identity to SEQ ID NO:20, wherein the polynucleotide encodes a polypeptide having an isoleucine residue at the position corresponding to amino acid residue position 1174 of SEQ ID NO:2, and wherein the polynucleotide encodes a polypeptide having kinase activity that is resistant to at least one ALK small-molecule kinase inhibitor;
   k) a nucleotide sequence having at least 90% sequence identity to SEQ ID NO:21 or a nucleotide sequence encoding an amino acid sequence having at least 90% sequence identity to SEQ ID NO:22, wherein the polynucleotide encodes a polypeptide having a valine residue at the position corresponding to amino acid residue position 1174 of SEQ ID NO:2, and wherein the polynucleotide encodes a polypeptide having kinase activity that is resistant to at least one ALK small-molecule kinase inhibitor;
   l) a nucleotide sequence having at least 90% sequence identity to SEQ ID NO:25 or a nucleotide sequence encoding an amino acid sequence having at least 90% sequence identity to SEQ ID NO:26, wherein the polynucleotide encodes a polypeptide having an arginine residue at the position corresponding to amino acid residue position 1202 of SEQ ID NO:2, and wherein the polynucleotide encodes a polypeptide having kinase activity that is resistant to at least one ALK small-molecule kinase inhibitor;
   m) a nucleotide sequence having at least 90% sequence identity to SEQ ID NO:27 or a nucleotide sequence encoding an amino acid sequence having at least 90% sequence identity to SEQ ID NO:28, wherein the polynucleotide encodes a polypeptide having an asparagine residue at the position corresponding to amino acid residue position 1203 of SEQ ID NO:2, and wherein the polynucleotide encodes a polypeptide having kinase activity that is resistant to at least one ALK small-molecule kinase inhibitor;
   n) a nucleotide sequence having at least 90% sequence identity to SEQ ID NO:29 or a nucleotide sequence encoding an amino acid sequence having at least 90% sequence identity to SEQ ID NO:30, wherein the polynucleotide encodes a polypeptide having a lysine residue at the position corresponding to amino acid residue position 1210 of SEQ ID NO:2, and wherein the polynucleotide encodes a polypeptide having kinase activity that is resistant to at least one ALK small-molecule kinase inhibitor;
   o) a nucleotide sequence having at least 90% sequence identity to SEQ ID NO:31 or a nucleotide sequence encoding an amino acid sequence having at least 90% sequence identity to SEQ ID NO:32, wherein the polynucleotide encodes a polypeptide having an alanine residue at the position corresponding to amino acid residue position 1269 of SEQ ID NO:2, and wherein the polynucleotide encodes a polypeptide having kinase activity that is resistant to at least one ALK small-molecule kinase inhibitor;

p) a nucleotide sequence having at least 90% sequence identity to SEQ ID NO:98 or a nucleotide sequence encoding an amino acid sequence having at least 90% sequence identity to SEQ ID NO:99, wherein the polynucleotide encodes a polypeptide having a lysine residue at the position corresponding to amino acid residue position 1406 of SEQ ID NO:2, and wherein the polynucleotide encodes a polypeptide having kinase activity that is resistant to at least one ALK small-molecule kinase inhibitor;

q) a nucleotide sequence having at least 90% sequence identity to SEQ ID NO:100 or a nucleotide sequence encoding an amino acid sequence having at least 90% sequence identity to SEQ ID NO:101, wherein the polynucleotide encodes a polypeptide having a lysine residue at the position corresponding to amino acid residue position 1408 of SEQ ID NO:2, and wherein the polynucleotide encodes a polypeptide having kinase activity that is resistant to at least one ALK small-molecule kinase inhibitor; and, r) a nucleotide sequence having at least 90% sequence identity to SEQ ID NO:102 or a nucleotide sequence encoding an amino acid sequence having at least 90% sequence identity to SEQ ID NO:103, wherein the polynucleotide encodes a polypeptide having a leucine residue at the position corresponding to amino acid residue position 1174 of SEQ ID NO:2, and wherein the polynucleotide encodes a polypeptide having kinase activity that is resistant to at least one ALK small-molecule kinase inhibitor.

2. The isolated polynucleotide of embodiment 1, wherein said polynucleotide comprises a nucleotide sequence selected from the group consisting of:

a) a nucleotide sequence having at least 95% sequence identity to SEQ ID NO:5 or a nucleotide sequence encoding an amino acid sequence having at least 95% sequence identity to SEQ ID NO:6, wherein the polynucleotide encodes a polypeptide having a serine residue at the position corresponding to amino acid residue position 1123 of SEQ ID NO:2, and wherein the polynucleotide encodes a polypeptide having kinase activity that is resistant to at least one anaplastic lymphoma kinase (ALK) small-molecule kinase inhibitor;

b) a nucleotide sequence having at least 95% sequence identity to SEQ ID NO:7 or a nucleotide sequence encoding an amino acid sequence having at least 95% sequence identity to SEQ ID NO:8, wherein the polynucleotide encodes a polypeptide having an alanine residue at the position corresponding to amino acid residue position 1123 of SEQ ID NO:2, and wherein the polynucleotide encodes a polypeptide having kinase activity that is resistant to at least one ALK small-molecule kinase inhibitor;

c) a nucleotide sequence having at least 95% sequence identity to SEQ ID NO:9 or a nucleotide sequence encoding an amino acid sequence having at least 95% sequence identity to SEQ ID NO:10, wherein the polynucleotide encodes a polypeptide having a valine residue thereof at the position corresponding to amino acid residue position 1129 of SEQ ID NO:2, and wherein the polynucleotide encodes a polypeptide having kinase activity that is resistant to at least one ALK small-molecule kinase inhibitor;

d) a nucleotide sequence having at least 95% sequence identity to SEQ ID NO:11 or a nucleotide sequence encoding an amino acid sequence having at least 95% sequence identity to SEQ ID NO:12, wherein the polynucleotide encodes a polypeptide having a lysine residue at the position corresponding to amino acid residue position 1132 of SEQ ID NO:2, and wherein the polynucleotide encodes a polypeptide having kinase activity that is resistant to at least one ALK small-molecule kinase inhibitor;

e) a nucleotide sequence having at least 95% sequence identity to SEQ ID NO:13 or a nucleotide sequence encoding an amino acid sequence having at least 95% sequence identity to SEQ ID NO:14, wherein the polynucleotide encodes a polypeptide having a methionine residue at the position corresponding to amino acid residue position 1151 of SEQ ID NO:2, and wherein the polynucleotide encodes a polypeptide having kinase activity that is resistant to at least one ALK small-molecule kinase inhibitor;

f) a nucleotide sequence having at least 95% sequence identity to SEQ ID NO:15 or a nucleotide sequence encoding an amino acid sequence having at least 95% sequence identity to SEQ ID NO:16, wherein the polynucleotide encodes a polypeptide having a tyrosine residue at the position corresponding to amino acid residue position 1156 of SEQ ID NO:2, and wherein the polynucleotide encodes a polypeptide having kinase activity that is resistant to at least one ALK small-molecule kinase inhibitor;

g) a nucleotide sequence having at least 95% sequence identity to SEQ ID NO:17 or a nucleotide sequence encoding an amino acid sequence having at least 95% sequence identity to SEQ ID NO:18, wherein the polynucleotide encodes a polypeptide having a cysteine residue at the position corresponding to amino acid residue position 1174 of SEQ ID NO:2, and wherein the polynucleotide encodes a polypeptide having kinase activity that is resistant to at least one ALK small-molecule kinase inhibitor;

h) a nucleotide sequence having at least 95% sequence identity to SEQ ID NO:19 or a nucleotide sequence encoding an amino acid sequence having at least 95% sequence identity to SEQ ID NO:20, wherein the polynucleotide encodes a polypeptide having an isoleucine residue at the position corresponding to amino acid residue position 1174 of SEQ ID NO:2, and wherein the polynucleotide encodes a polypeptide having kinase activity that is resistant to at least one ALK small-molecule kinase inhibitor;

i) a nucleotide sequence having at least 95% sequence identity to SEQ ID NO:21 or a nucleotide sequence encoding an amino acid sequence having at least 95% sequence identity to SEQ ID NO:22, wherein the polynucleotide encodes a polypeptide having a valine residue at the position corresponding to amino acid residue position 1174 of SEQ ID NO:2, and wherein the polynucleotide encodes a polypeptide having kinase activity that is resistant to at least one ALK small-molecule kinase inhibitor;

j) a nucleotide sequence having at least 95% sequence identity to SEQ ID NO:25 or a nucleotide sequence encoding an amino acid sequence having at least 95% sequence identity to SEQ ID NO:26, wherein the polynucleotide encodes a polypeptide having an arginine residue at the position corresponding to amino acid residue position 1202 of SEQ ID NO:2, and wherein the polynucleotide encodes a polypeptide having kinase activity that is resistant to at least one ALK small-molecule kinase inhibitor;

k) a nucleotide sequence having at least 95% sequence identity to SEQ ID NO:27 or a nucleotide sequence encoding an amino acid sequence having at least 95% sequence identity to SEQ ID NO:28, wherein the polynucleotide encodes a polypeptide having an asparagine residue at the position corresponding to amino acid residue position 1203 of SEQ ID NO:2, and wherein the polynucleotide encodes a polypeptide having kinase activity that is resistant to at least one ALK small-molecule kinase inhibitor;

l) a nucleotide sequence having at least 95% sequence identity to SEQ ID NO:29 or a nucleotide sequence encoding an amino acid sequence having at least 95% sequence identity to SEQ ID NO:30, wherein the polynucleotide encodes a polypeptide having a lysine residue at the position corresponding to amino acid residue position 1210 of SEQ ID NO:2, and wherein the polynucleotide encodes a polypeptide having kinase activity that is resistant to at least one ALK small-molecule kinase inhibitor;

m) a nucleotide sequence having at least 95% sequence identity to SEQ ID NO:31 or a nucleotide sequence encoding an amino acid sequence having at least 95% sequence identity to SEQ ID NO:32, wherein the polynucleotide encodes a polypeptide having an alanine residue at the position corresponding to amino acid residue position 1269 of SEQ ID NO:2, and wherein the polynucleotide encodes a polypeptide having kinase activity that is resistant to at least one ALK small-molecule kinase inhibitor;

n) a nucleotide sequence having at least 95% sequence identity to SEQ ID NO:98 or a nucleotide sequence encoding an amino acid sequence having at least 95% sequence identity to SEQ ID NO:99, wherein the polynucleotide encodes a polypeptide having a lysine residue at the position corresponding to amino acid residue position 1406 of SEQ ID NO:2, and wherein the polynucleotide encodes a polypeptide having kinase activity that is resistant to at least one ALK small-molecule kinase inhibitor;

o) a nucleotide sequence having at least 95% sequence identity to SEQ ID NO:100 or a nucleotide sequence encoding an amino acid sequence having at least 95% sequence identity to SEQ ID NO:101, wherein the polynucleotide encodes a polypeptide having a lysine residue at the position corresponding to amino acid residue position 1408 of SEQ ID NO:2, and wherein the polynucleotide encodes a polypeptide having kinase activity that is resistant to at least one ALK small-molecule kinase inhibitor; and, p) a nucleotide sequence having at least 95% sequence identity to SEQ ID NO:102 or a nucleotide sequence encoding an amino acid sequence having at least 95% sequence identity to SEQ ID NO:103, wherein the polynucleotide encodes a polypeptide having a leucine residue at the position corresponding to amino acid residue position 1174 of SEQ ID NO:2, and wherein the polynucleotide encodes a polypeptide having kinase activity that is resistant to at least one ALK small-molecule kinase inhibitor.

3. The isolated polynucleotide of embodiment 1, wherein said polynucleotide comprises a nucleotide sequence selected from the group consisting of:
   a) the nucleotide sequence set forth in SEQ ID NO:33, 35, 37, 39, 41, 43, 45, 47, 49, 53, 55, 57, 59, 61, 63, or 104;
   b) a nucleotide sequence encoding the amino acid sequence set forth in SEQ ID NO:34, 36, 38, 40, 42, 44, 46, 48, 50, 54, 56, 58, 60, 62, 64, or 105;
   c) a nucleotide sequence having at least 90% sequence identity to SEQ ID NO: 33, 35, 37, 39, 41, 43, 45, 47, 49, 53, 55, 57, 59, 61, 63, or 104, wherein the polynucleotide encodes a polypeptide having kinase activity that is resistant to at least one ALK small-molecule kinase inhibitor; and
   d) a nucleotide sequence that encodes a polypeptide having an amino acid sequence having at least 90% sequence identity to SEQ ID NO: 34, 36, 38, 40, 42, 44, 46, 48, 50, 54, 56, 58, 60, 62, 64, or 105, wherein the polynucleotide encodes a polypeptide having kinase activity that is resistant to at least one ALK small-molecule kinase inhibitor.

4. The isolated polynucleotide of embodiment 3, wherein said polynucleotide further comprises a nucleotide sequence encoding an ALK oncogenic fusion protein partner, and wherein said polynucleotide encodes an ALK oncogenic fusion protein.

5. The isolated polynucleotide of embodiment 4, wherein said ALK oncogenic fusion protein partner is selected from the group consisting of nucleophosmin (NPM), non-muscle tropomyosin 3 (TPM3), 5-aminoimidazole-4-carboxamide ribonucleotide formyltransferase/IMP cyclohydrolase (ATIC), clathrin heavy chain (CLTC), TRK-fused gene (TFG), non-muscle tropomyosin 4 (TPM4), moesin (MSN), Ran-binding protein 2 (RanBP2), echinoderm microtubule-associated protein-like 4 (EML4), cysteinyl-tRNA synthetase (CARS), kinesin family member 5B (KIF5B), non-muscle myosin heavy chain 9 (MYH9), SEC31 homolog A (SEC31L1), and ring finger protein 213 (RNF213)/ALK lymphoma oligomerization partner on chromosome 17 (ALO17).

6. The isolated polynucleotide of embodiment 5, wherein said ALK oncogenic fusion protein partner has the amino acid sequence set forth in SEQ ID NO:97.

7. The isolated polynucleotide of embodiment 1, wherein said polynucleotide comprises a nucleotide sequence selected from the group consisting of:
   a) the nucleotide sequence set forth in SEQ ID NO: 65, 67, 69, 71, 73, 75, 77, 79, 81, 85, 87, 89, 91, 93, 95, or 106;
   b) a nucleotide sequence encoding the amino acid sequence set forth in SEQ ID NO: 66, 68, 70, 72, 74, 76, 78, 80, 82, 86, 88, 90, 92, 94, 96, or 107;
   c) a nucleotide sequence having at least 90% sequence identity to SEQ ID NO: 65, 67, 69, 71, 73, 75, 77, 79, 81, 85, 87, 89, 91, 93, 95, or 106, wherein the polynucleotide encodes a polypeptide having kinase activity that is resistant to at least one ALK small-molecule kinase inhibitor; and
   d) a nucleotide sequence that encodes a polypeptide having an amino acid sequence having at least 90% sequence identity to SEQ ID NO: 66, 68, 70, 72, 74, 76, 78, 80, 82, 86, 88, 90, 92, 94, 96, or 107, wherein the polynucleotide encodes a polypeptide having kinase activity that is resistant to at least one ALK small-molecule kinase inhibitor.

8. The isolated polynucleotide of any one of embodiments 1-7, wherein said ALK small-molecule kinase inhibitor is selected from the group consisting of PF-0234166, NVP-TAE684, staurosporine, 7-hydroxystaurosporine, CEP- 14083, CEP-14513, CEP-28122, pyridone 14, pyridone 15, CRL151104A, and WZ-5-126.

9. The isolated polynucleotide of embodiment 8, wherein said ALK small-molecule kinase inhibitor is PF-02341066.

10. An expression cassette comprising the isolated polynucleotide of any one of embodiments 1-9 operably linked to a promoter.

11. A host cell comprising the expression cassette of embodiment 10.

12. An isolated polypeptide comprising an amino acid sequence selected from the group consisting of:
  a) the amino acid sequence set forth in SEQ ID NO: 6, 8, 10, 12, 14, 16, 18, 20, 22, 26, 28, 30, 32, 99, 101, 103;
  b) an amino acid sequence having at least 90% sequence identity to SEQ ID NO:6, wherein the polypeptide has a serine residue at the position corresponding to amino acid residue position 1123 of SEQ ID NO:2, and wherein the polypeptide has kinase activity that is resistant to at least one anaplastic lymphoma kinase (ALK) small-molecule kinase inhibitor;
  c) an amino acid sequence having at least 90% sequence identity to SEQ ID NO:8, wherein the polypeptide has an alanine residue at the position corresponding to amino acid residue position 1123 of SEQ ID NO:2, and wherein the polypeptide has kinase activity that is resistant to at least one ALK small-molecule kinase inhibitor;
  d) an amino acid sequence having at least 90% sequence identity to SEQ ID NO:10, wherein the polypeptide has a valine residue at the position corresponding to amino acid residue position 1129 of SEQ ID NO:2, and wherein the polypeptide has kinase activity that is resistant to at least one ALK small-molecule kinase inhibitor;
  e) an amino acid sequence having at least 90% sequence identity to SEQ ID NO:12, wherein the polypeptide has a lysine residue at the position corresponding to amino acid residue position 1132 of SEQ ID NO:2, and wherein the polypeptide has kinase activity that is resistant to at least one ALK small-molecule kinase inhibitor;
  f) an amino acid sequence having at least 90% sequence identity to SEQ ID NO:14, wherein the polypeptide has a methionine residue at the position corresponding to amino acid residue position 1151 of SEQ ID NO:2, and wherein the polypeptide has kinase activity that is resistant to at least one ALK small-molecule kinase inhibitor;
  g) an amino acid sequence having at least 90% sequence identity to SEQ ID NO:16, wherein the polypeptide has a tyrosine residue at the position corresponding to amino acid residue position 1156 of SEQ ID NO:2, and wherein the polypeptide has kinase activity that is resistant to at least one ALK small-molecule kinase inhibitor;
  h) an amino acid sequence having at least 90% sequence identity to SEQ ID NO:18, wherein the polypeptide has a cysteine residue at the position corresponding to amino acid residue position 1174 of SEQ ID NO:2, and wherein the polypeptide has kinase activity that is resistant to at least one ALK small-molecule kinase inhibitor;
  i) an amino acid sequence having at least 90% sequence identity to SEQ ID NO:20, wherein the polypeptide has an isoleucine residue at the position corresponding to amino acid residue position 1174 of SEQ ID NO:2, and wherein the polypeptide has kinase activity that is resistant to at least one ALK small-molecule kinase inhibitor;
  j) an amino acid sequence having at least 90% sequence identity to SEQ ID NO:22, wherein the polypeptide has a valine residue at the position corresponding to amino acid residue position 1174 of SEQ ID NO:2, and wherein the polypeptide has kinase activity that is resistant to at least one ALK small-molecule kinase inhibitor;
  k) an amino acid sequence having at least 90% sequence identity to SEQ ID NO:26, wherein the polypeptide has an arginine residue at the position corresponding to amino acid residue position 1202 of SEQ ID NO:2, and wherein the polypeptide has kinase activity that is resistant to at least one ALK small-molecule kinase inhibitor;
  l) an amino acid sequence having at least 90% sequence identity to SEQ ID NO:28, wherein the polypeptide has an asparagine residue at the position corresponding to amino acid residue position 1203 of SEQ ID NO:2, and wherein the polypeptide has kinase activity that is resistant to at least one ALK small-molecule kinase inhibitor;
  m) an amino acid sequence having at least 90% sequence identity to SEQ ID NO:30, wherein the polypeptide has a lysine residue at the position corresponding to amino acid residue position 1210 of SEQ ID NO:2, and wherein the polypeptide has kinase activity that is resistant to at least one ALK small-molecule kinase inhibitor;
  n) an amino acid sequence having at least 90% sequence identity to SEQ ID NO:32, wherein the polypeptide has an alanine residue at the position corresponding to amino acid residue position 1269 of SEQ ID NO:2, and wherein the polypeptide has kinase activity that is resistant to at least one ALK small-molecule kinase inhibitor;
  o) an amino acid sequence having at least 90% sequence identity to SEQ ID NO:99, wherein the polypeptide has a lysine residue at the position corresponding to amino acid residue position 1406 of SEQ ID NO:2, and wherein the polypeptide has kinase activity that is resistant to at least one ALK small-molecule kinase inhibitor;
  p) an amino acid sequence having at least 90% sequence identity to SEQ ID NO:101, wherein the polypeptide has a lysine residue at the position corresponding to amino acid residue position 1408 of SEQ ID NO:2, and wherein the polypeptide has kinase activity that is resistant to at least one ALK small-molecule kinase inhibitor; and,
  q) an amino acid sequence having at least 90% sequence identity to SEQ ID NO:103, wherein the polypeptide has a leucine residue at the position corresponding to amino acid residue position 1174 of SEQ ID NO:2, and wherein the polypeptide has kinase activity that is resistant to at least one ALK small-molecule kinase inhibitor.

13. The isolated polypeptide of embodiment 12, wherein said polypeptide comprises an amino acid sequence selected from the group consisting of:
  a) an amino acid sequence having at least 95% sequence identity to SEQ ID NO:6, wherein the polypeptide has a serine residue at the position corresponding to amino acid residue position 1123 of SEQ ID NO:2, and wherein the polypeptide has kinase activity that is resistant to at least one anaplastic lymphoma kinase (ALK) small-molecule kinase inhibitor;
  b) an amino acid sequence having at least 95% sequence identity to SEQ ID NO:8, wherein the polypeptide has an alanine residue at the position corresponding to amino acid residue position 1123 of SEQ ID NO:2, and wherein the polypeptide has kinase activity that is resistant to at least one ALK small-molecule kinase inhibitor;
  c) an amino acid sequence having at least 95% sequence identity to SEQ ID NO:10, wherein the polypeptide has a valine residue at the position corresponding to amino acid residue position 1129 of SEQ ID NO:2, and wherein the polypeptide has kinase activity that is resistant to at least one ALK small-molecule kinase inhibitor;

d) an amino acid sequence having at least 95% sequence identity to SEQ ID NO:12, wherein the polypeptide has a lysine residue at the position corresponding to amino acid residue position 1132 of SEQ ID NO:2, and wherein the polypeptide has kinase activity that is resistant to at least one ALK small-molecule kinase inhibitor;
e) an amino acid sequence having at least 95% sequence identity to SEQ ID NO:14, wherein the polypeptide has a methionine residue at the position corresponding to amino acid residue position 1151 of SEQ ID NO:2, and wherein the polypeptide has kinase activity that is resistant to at least one ALK small-molecule kinase inhibitor;
f) an amino acid sequence having at least 95% sequence identity to SEQ ID NO:16, wherein the polypeptide has a tyrosine residue at the position corresponding to amino acid residue position 1156 of SEQ ID NO:2, and wherein the polypeptide has kinase activity that is resistant to at least one ALK small-molecule kinase inhibitor;
g) an amino acid sequence having at least 95% sequence identity to SEQ ID NO:18, wherein the polypeptide has a cysteine residue at the position corresponding to amino acid residue position 1174 of SEQ ID NO:2, and wherein the polypeptide has kinase activity that is resistant to at least one ALK small-molecule kinase inhibitor;
h) an amino acid sequence having at least 95% sequence identity to SEQ ID NO:20, wherein the polypeptide has an isoleucine residue at the position corresponding to amino acid residue position 1174 of SEQ ID NO:2, and wherein the polypeptide has kinase activity that is resistant to at least one ALK small-molecule kinase inhibitor;
i) an amino acid sequence having at least 95% sequence identity to SEQ ID NO:22, wherein the polypeptide has a valine residue at the position corresponding to amino acid residue position 1174 of SEQ ID NO:2, and wherein the polypeptide has kinase activity that is resistant to at least one ALK small-molecule kinase inhibitor;
j) an amino acid sequence having at least 95% sequence identity to SEQ ID NO:26, wherein the polypeptide has an arginine residue at the position corresponding to amino acid residue position 1202 of SEQ ID NO:2, and wherein the polypeptide has kinase activity that is resistant to at least one ALK small-molecule kinase inhibitor;
k) an amino acid sequence having at least 95% sequence identity to SEQ ID NO:28, wherein the polypeptide has an asparagine residue at the position corresponding to amino acid residue position 1203 of SEQ ID NO:2, and wherein the polypeptide has kinase activity that is resistant to at least one ALK small-molecule kinase inhibitor;
l) an amino acid sequence having at least 95% sequence identity to SEQ ID NO:30, wherein the polypeptide has a lysine residue at the position corresponding to amino acid residue position 1210 of SEQ ID NO:2, and wherein the polypeptide has kinase activity that is resistant to at least one ALK small-molecule kinase inhibitor;
m) an amino acid sequence having at least 95% sequence identity to SEQ ID NO:32, wherein the polypeptide has an alanine residue at the position corresponding to amino acid residue position 1269 of SEQ ID NO:2, and wherein the polypeptide has kinase activity that is resistant to at least one ALK small-molecule kinase inhibitor;
n) an amino acid sequence having at least 95% sequence identity to SEQ ID NO:99, wherein the polypeptide has a lysine residue at the position corresponding to amino acid residue position 1406 of SEQ ID NO:2, and wherein the polypeptide has kinase activity that is resistant to at least one ALK small-molecule kinase inhibitor;
o) an amino acid sequence having at least 95% sequence identity to SEQ ID NO:101, wherein the polypeptide has a lysine residue at the position corresponding to amino acid residue position 1408 of SEQ ID NO:2, and wherein the polypeptide has kinase activity that is resistant to at least one ALK small-molecule kinase inhibitor; and,
p) an amino acid sequence having at least 95% sequence identity to SEQ ID NO:103, wherein the polypeptide has a leucine residue at the position corresponding to amino acid residue position 1174 of SEQ ID NO:2, and wherein the polypeptide has kinase activity that is resistant to at least one ALK small-molecule kinase inhibitor.

14. The isolated polypeptide of embodiment 12, wherein said polypeptide comprises an amino acid sequence selected from the group consisting of:
   a) the amino acid sequence set forth in SEQ ID NO:34, 36, 38, 40, 42, 44, 46, 48, 50, 54, 56, 58, 60, 62, 64, or 105; and
   b) an amino acid sequence having at least 90% sequence identity to SEQ ID NO: 34, 36, 38, 40, 42, 44, 46, 48, 50, 54, 56, 58, 60, 62, 64, or 105, wherein the polypeptide has kinase activity that is resistant to at least one ALK small-molecule kinase inhibitor.

15. The isolated polypeptide of embodiment 14, wherein said polypeptide further comprises an ALK oncogenic fusion protein partner, thus forming an ALK oncogene fusion protein.

16. The isolated polypeptide of embodiment 15, wherein said ALK oncogenic fusion protein partner is selected from the group consisting of nucleophosmin (NPM), non-muscle tropomyosin 3 (TPM3), 5-aminoimidazole-4-carboxamide ribonucleotide formyltransferase/IMP cyclohydrolase (ATIC), clathrin heavy chain (CLTC), TRK-fused gene (TFG), non-muscle tropomyosin 4 (TPM4), moesin (MSN), Ran-binding protein 2 (RanBP2), echinoderm microtubule-associated protein-like 4 (EML4), cysteinyl-tRNA synthetase (CARS), kinesin family member 5B (KIF5B), non-muscle myosin heavy chain 9 (MYH9), SEC31 homolog A (SEC31L1), and ring finger protein 213 (RNF213)/ALK lymphoma oligomerization partner on chromosome 17 (ALO17).

17. The isolated polypeptide of embodiment 16, wherein said ALK oncogenic fusion protein partner has the amino acid sequence set forth in SEQ ID NO:97.

18. The isolated polypeptide of embodiment 12, wherein said polypeptide comprises an amino acid sequence selected from the group consisting of:
   a) the amino acid sequence set forth in SEQ ID NO: 66, 68, 70, 72, 74, 76, 78, 80, 82, 86, 88, 90, 92, 94, 96, or 107; and
   b) an amino acid sequence having at least 90% sequence identity to SEQ ID NO: 66, 68, 70, 72, 74, 76, 78, 80, 82, 86, 88, 90, 92, 94, 96, or 107, wherein the polypeptide has kinase activity that is resistant to at least one ALK small-molecule kinase inhibitor.

19. The isolated polypeptide of any one of embodiments 12-18, wherein said ALK small-molecule kinase inhibitor is selected from the group consisting of PF-0234166, NVP-TAE684, staurosporine, 7-hydroxystaurosporine, CEP-14083, CEP-14513, CEP-28122, pyridone 14, pyridone 15, CRL151104A, and WZ-5-126.

20. The isolated polypeptide of embodiment 19, wherein said ALK small-molecule kinase inhibitor is PF-02341066.

21. A non-human transgenic animal that has been altered to express an ALK resistance mutant polypeptide that is resistant to at least one ALK small-molecule kinase inhibitor, wherein said ALK resistance mutant polypeptide has at least one ALK kinase inhibitor resistance mutant residue selected from the group consisting of:
  a) a serine residue at the position corresponding to amino acid residue position 1123 of SEQ ID NO:2;
  b) an alanine residue at the position corresponding to amino acid residue position 1123 of SEQ ID NO:2;
  c) a valine residue at the position corresponding to amino acid residue position 1129 of SEQ ID NO:2;
  d) a lysine residue at the position corresponding to amino acid residue position 1132 of SEQ ID NO:2;
  e) a methionine residue at the position corresponding to amino acid residue position 1151 of SEQ ID NO:2;
  f) a tyrosine residue at the position corresponding to amino acid residue position 1156 of SEQ ID NO:2;
  g) a cysteine residue at the position corresponding to amino acid residue position 1174 of SEQ ID NO:2;
  h) an isoleucine residue at the position corresponding to amino acid residue position 1174 of SEQ ID NO:2;
  i) a valine residue at the position corresponding to amino acid residue position 1174 of SEQ ID NO:2;
  j) a leucine residue at the position corresponding to amino acid residue position 1174 of SEQ ID NO:2;
  k) an arginine residue at the position corresponding to amino acid residue position 1202 of SEQ ID NO:2;
  l) an asparagine residue at the position corresponding to amino acid residue position 1203 of SEQ ID NO:2;
  m) a lysine residue at the position corresponding to amino acid residue position 1210 of SEQ ID NO:2;
  n) an alanine residue at the position corresponding to amino acid residue position 1269 of SEQ ID NO:2;
  o) a lysine residue at the position corresponding to amino acid residue position 1406 of SEQ ID NO:2; and,
  p) a lysine residue at the position corresponding to amino acid residue position 1408 of SEQ ID NO:2.

22. An antibody that specifically binds an ALK resistance mutant polypeptide that is resistant to at least one ALK small-molecule kinase inhibitor, wherein said ALK resistance mutant polypeptide has at least one ALK kinase inhibitor resistance mutant residue selected from the group consisting of:
  a) a serine residue at the position corresponding to amino acid residue position 1123 of SEQ ID NO:2;
  b) an alanine residue at the position corresponding to amino acid residue position 1123 of SEQ ID NO:2;
  c) a valine residue at the position corresponding to amino acid residue position 1129 of SEQ ID NO:2;
  d) a lysine residue at the position corresponding to amino acid residue position 1132 of SEQ ID NO:2;
  e) a methionine residue at the position corresponding to amino acid residue position 1151 of SEQ ID NO:2;
  f) a tyrosine residue at the position corresponding to amino acid residue position 1156 of SEQ ID NO:2;
  g) a cysteine residue at the position corresponding to amino acid residue position 1174 of SEQ ID NO:2;
  h) an isoleucine residue at the position corresponding to amino acid residue position 1174 of SEQ ID NO:2;
  i) a valine residue at the position corresponding to amino acid residue position 1174 of SEQ ID NO:2;
  j) a leucine residue at the position corresponding to amino acid residue position 1174 of SEQ ID NO:2;
  k) an arginine residue at the position corresponding to amino acid residue position 1202 of SEQ ID NO:2;
  l) an asparagine residue at the position corresponding to amino acid residue position 1203 of SEQ ID NO:2;
  m) a lysine residue at the position corresponding to amino acid residue position 1210 of SEQ ID NO:2;
  n) an alanine residue at the position corresponding to amino acid residue position 1269 of SEQ ID NO:2;
  o) a lysine residue at the position corresponding to amino acid residue position 1406 of SEQ ID NO:2; and,
  p) a lysine residue at the position corresponding to amino acid residue position 1408 of SEQ ID NO:2.

23. The antibody of embodiment 22, wherein said ALK resistance mutant polypeptide comprises the isolated polypeptide of any one of embodiments 12-20.

24. A kit for detecting an ALK inhibitor resistance mutation in a biological sample comprising the antibody of embodiment 22 or 23.

25. The kit of embodiment 24, further comprising chemicals for the detection of antibody binding to ALK.

26. A kit for detecting an ALK inhibitor resistance mutation in a biological sample comprising a reagent comprising at least one polynucleotide that can specifically detect or specifically amplify an ALK resistance mutant polynucleotide having an ALK inhibitor resistance mutation, wherein said ALK resistance mutant polynucleotide encodes an ALK resistance mutant polypeptide that is resistant to at least one ALK small-molecule kinase inhibitor, wherein said ALK resistance mutant polypeptide has at least one ALK kinase inhibitor resistance mutant residue selected from the group consisting of:
  a) a serine residue at the position corresponding to amino acid residue position 1123 of SEQ ID NO:2;
  b) an alanine residue at the position corresponding to amino acid residue position 1123 of SEQ ID NO:2;
  c) a valine residue at the position corresponding to amino acid residue position 1129 of SEQ ID NO:2;
  d) a lysine residue at the position corresponding to amino acid residue position 1132 of SEQ ID NO:2;
  e) a methionine residue at the position corresponding to amino acid residue position 1151 of SEQ ID NO:2;
  f) a tyrosine residue at the position corresponding to amino acid residue position 1156 of SEQ ID NO:2;
  g) a cysteine residue at the position corresponding to amino acid residue position 1174 of SEQ ID NO:2;
  h) an isoleucine residue at the position corresponding to amino acid residue position 1174 of SEQ ID NO:2;
  i) a valine residue at the position corresponding to amino acid residue position 1174 of SEQ ID NO:2;
  j) a leucine residue at the position corresponding to amino acid residue position 1174 of SEQ ID NO:2;
  k) an arginine residue at the position corresponding to amino acid residue position 1202 of SEQ ID NO:2;
  l) an asparagine residue at the position corresponding to amino acid residue position 1203 of SEQ ID NO:2;
  m) a lysine residue at the position corresponding to amino acid residue position 1210 of SEQ ID NO:2;
  n) an alanine residue at the position corresponding to amino acid residue position 1269 of SEQ ID NO:2;
  o) a lysine residue at the position corresponding to amino acid residue position 1406 of SEQ ID NO:2; and,
  p) a lysine residue at the position corresponding to amino acid residue position 1408 of SEQ ID NO:2.

27. The kit of embodiment 26, wherein said at least one polynucleotide that can specifically detect or specifically amplify an ALK resistance mutant polynucleotide is capable of specifically detecting or specifically amplifying the polynucleotide of any one of embodiments 1-9.

28. The kit of embodiment 26, wherein said reagent comprises a pair of primers that amplify an amplicon comprising said ALK inhibitor resistance mutation.

29. The kit of embodiment 26, wherein said reagent comprises at least one probe comprising a polynucleotide sequence that hybridizes under stringent conditions to said ALK resistance mutant polynucleotide and thereby detects the ALK inhibitor resistance mutation.

30. A method for assaying a biological sample for an ALK inhibitor resistance mutation comprising contacting said biological sample with the antibody of embodiment 22 and detecting binding of said antibody to ALK having the ALK inhibitor resistance mutation.

31. A method for diagnosing a cancer that is resistant to or likely to develop resistance to at least one ALK small-molecule kinase inhibitor in a patient having cancer that is associated with aberrant ALK activity comprising assaying a biological sample from said patient for the presence of an ALK inhibitor resistance mutation, said method comprising contacting said biological sample with the antibody of embodiment 22, and detecting binding of said antibody to ALK having said ALK inhibitor resistance mutation, wherein the presence of said ALK having said ALK inhibitor resistance mutation is indicative of said patient having a cancer that is resistant to or likely to develop resistance to at least one ALK small molecule kinase inhibitor.

32. A method for assaying a biological sample for an ALK inhibitor resistance mutation comprising contacting said biological sample with a reagent comprising at least one polynucleotide that can specifically detect or specifically amplify an ALK resistance mutant polynucleotide having an ALK inhibitor resistance mutation, wherein said ALK resistance mutant polynucleotide encodes an ALK resistance mutant polypeptide that is resistant to at least one ALK small-molecule kinase inhibitor, wherein said ALK resistance mutant polypeptide has at least one ALK kinase inhibitor resistance mutant residue selected from the group consisting of:
  a) a serine residue at the position corresponding to amino acid residue position 1123 of SEQ ID NO:2;
  b) an alanine residue at the position corresponding to amino acid residue position 1123 of SEQ ID NO:2;
  c) a valine residue at the position corresponding to amino acid residue position 1129 of SEQ ID NO:2;
  d) a lysine residue at the position corresponding to amino acid residue position 1132 of SEQ ID NO:2;
  e) a methionine residue at the position corresponding to amino acid residue position 1151 of SEQ ID NO:2;
  f) a tyrosine residue at the position corresponding to amino acid residue position 1156 of SEQ ID NO:2;
  g) a cysteine residue at the position corresponding to amino acid residue position 1174 of SEQ ID NO:2;
  h) an isoleucine residue at the position corresponding to amino acid residue position 1174 of SEQ ID NO:2;
  i) a valine residue at the position corresponding to amino acid residue position 1174 of SEQ ID NO:2;
  j) a leucine residue at the position corresponding to amino acid residue position 1174 of SEQ ID NO:2;
  k) an arginine residue at the position corresponding to amino acid residue position 1202 of SEQ ID NO:2;
  l) an asparagine residue at the position corresponding to amino acid residue position 1203 of SEQ ID NO:2;
  m) a lysine residue at the position corresponding to amino acid residue position 1210 of SEQ ID NO:2;
  n) an alanine residue at the position corresponding to amino acid residue position 1269 of SEQ ID NO:2;
  o) a lysine residue at the position corresponding to amino acid residue position 1406 of SEQ ID NO:2; and,
  p) a lysine residue at the position corresponding to amino acid residue position 1408 of SEQ ID NO:2.

33. A method for diagnosing a cancer that is resistant to or likely to develop resistance to at least one ALK small-molecule kinase inhibitor in a patient having cancer that is associated with aberrant ALK activity comprising assaying a biological sample from said patient for the presence of an ALK inhibitor resistance mutation, said method comprising contacting said biological sample with a reagent comprising at least one polynucleotide that can specifically detect or specifically amplify an ALK resistance mutant polynucleotide having an ALK inhibitor resistance mutation, wherein said ALK resistance mutant polynucleotide encodes an ALK resistance mutant polypeptide that is resistant to at least one ALK small-molecule kinase inhibitor, wherein said ALK resistance mutant polypeptide has at least one ALK kinase inhibitor resistance mutant residue selected from the group consisting of:
  a) a serine residue at the position corresponding to amino acid residue position 1123 of SEQ ID NO:2;
  b) an alanine residue at the position corresponding to amino acid residue position 1123 of SEQ ID NO:2;
  c) a valine residue at the position corresponding to amino acid residue position 1129 of SEQ ID NO:2;
  d) a lysine residue at the position corresponding to amino acid residue position 1132 of SEQ ID NO:2;
  e) a methionine residue at the position corresponding to amino acid residue position 1151 of SEQ ID NO:2;
  f) a tyrosine residue at the position corresponding to amino acid residue position 1156 of SEQ ID NO:2;
  g) a cysteine residue at the position corresponding to amino acid residue position 1174 of SEQ ID NO:2;
  h) an isoleucine residue at the position corresponding to amino acid residue position 1174 of SEQ ID NO:2;
  i) a valine residue at the position corresponding to amino acid residue position 1174 of SEQ ID NO:2;
  j) a leucine residue at the position corresponding to amino acid residue position 1174 of SEQ ID NO:2;
  k) an arginine residue at the position corresponding to amino acid residue position 1202 of SEQ ID NO:2;
  l) an asparagine residue at the position corresponding to amino acid residue position 1203 of SEQ ID NO:2;
  m) a lysine residue at the position corresponding to amino acid residue position 1210 of SEQ ID NO:2;
  n) an alanine residue at the position corresponding to amino acid residue position 1269 of SEQ ID NO:2;
  o) a lysine residue at the position corresponding to amino acid residue position 1406 of SEQ ID NO:2; and,
  p) a lysine residue at the position corresponding to amino acid residue position 1408 of SEQ ID NO:2;
and detecting the presence or absence of said ALK inhibitor resistance mutation in said biological sample, wherein the presence of said ALK inhibitor resistance mutation is indicative of said patient having a cancer that is resistant to or likely to develop resistance to at least one ALK small-molecule kinase inhibitor.

34. The method of embodiment 32 or 33, wherein said at least one polynucleotide that can specifically detect or specifically amplify an ALK resistance mutant polynucleotide is capable of specifically detecting or specifically amplifying the polynucleotide of any one of embodiments 1-9.

35. A method for diagnosing a cancer that is resistant to or likely to develop resistance to at least one ALK small-molecule kinase inhibitor in a subject comprising assaying a biological sample from said subject for the presence of an ALK oncogenic fusion protein having an ALK inhibitor resistance mutation, said method comprising contacting said biological sample with an antibody that specifically binds the polypeptide of any one of embodiments 15-17; and detecting binding of said antibody to said ALK oncogenic fusion protein having an ALK resistance mutation; wherein the presence of said ALK oncogenic fusion protein having an ALK inhibitor resistance mutation is indicative of said subject having a cancer that is resistant to or likely to develop resistance to at least one ALK small molecule kinase inhibitor.

36. A method for diagnosing a cancer that is resistant to or likely to develop resistance to at least one ALK small-molecule kinase inhibitor in a subject comprising assaying a biological sample from said subject for the presence of a polynucleotide encoding an ALK oncogenic fusion protein having an ALK inhibitor resistance mutation, said method comprising contacting said biological sample with a reagent comprising at least one polynucleotide that can specifically detect or specifically amplify the polynucleotide encoding an ALK oncogenic fusion protein having an ALK inhibitor resistance mutation, wherein said at least one polynucleotide is capable of specifically detecting or specifically amplifying the polynucleotide according to any one of embodiments 4-6; and detecting the presence or absence of said polynucleotide encoding an ALK oncogenic fusion protein having said ALK inhibitor resistance mutation in said biological sample; wherein the presence of said polynucleotide encoding said ALK oncogenic fusion protein having said ALK inhibitor resistance mutation is indicative of said subject having a cancer that is resistant to or likely to develop resistance to at least one ALK small molecule kinase inhibitor.

37. The method of any one of embodiments 30-36, wherein said ALK small-molecule kinase inhibitor is selected from the group consisting of PF-0234166, NVP-TAE684, staurosporine, 7-hydroxystaurosporine, CEP-14083, CEP-14513, CEP-28122, pyridone 14, pyridone 15, CRL151104A, and WZ-5-126.

38. The method of embodiment 37, wherein said ALK small-molecule kinase inhibitor is PF-02341066.

39. A method for diagnosing a cancer that is resistant to or likely to develop resistance to PF-02341066 in a patient having a cancer that is associated with aberrant ALK activity comprising assaying a biological sample from said patient for the presence of an ALK inhibitor resistance mutation, said method comprising contacting said biological sample with an antibody that specifically binds an ALK resistance mutant polypeptide that is resistant to PF-02341066, wherein said ALK resistance mutant polypeptide has a methionine residue at the position corresponding to amino acid residue position 1196 of SEQ ID NO:2; and detecting binding of said antibody to ALK having said ALK resistance mutation, wherein the presence of ALK having said ALK inhibitor resistance mutation is indicative of said patient having a cancer that is resistant to or likely to develop resistance to PF-02341066.

40. The method of embodiment 39, wherein said ALK resistance mutant polypeptide comprises an amino acid sequence selected from the group consisting of:
 a) the amino acid sequence set forth in SEQ ID NO:24; and
 b) an amino acid sequence having at least 90% sequence identity to SEQ ID NO:24, wherein the polypeptide has a methionine residue at the position corresponding to amino acid residue position 1196 of SEQ ID NO:2, and wherein the polypeptide has kinase activity that is resistant to PF-02341066;

41. The method of embodiment 39, wherein said ALK resistance mutant polypeptide comprises an amino acid sequence selected from the group consisting of:
 a) the amino acid sequence set forth in SEQ ID NO:52; and
 b) an amino acid sequence having at least 90% sequence identity to SEQ ID NO:52, wherein the polypeptide has kinase activity that is resistant to PF-02341066.

42. The method of embodiment 41, wherein said ALK resistance mutant polypeptide further comprises an ALK oncogenic fusion protein partner, thus comprising an ALK oncogenic fusion protein.

43. The method of embodiment 39, wherein said ALK resistance mutant polypeptide comprises an amino acid sequence selected from the group consisting of:
 a) the amino acid sequence set forth in SEQ ID NO:84; and
 b) an amino acid sequence having at least 90% sequence identity to SEQ ID NO:84, wherein the polypeptide has kinase activity that is resistant to PF-02341066.

44. A method for diagnosing a cancer that is resistant to or likely to develop resistance to PF-02341066 in a patient having cancer that is associated with aberrant ALK activity comprising assaying a biological sample from said subject for the presence of an ALK inhibitor resistance mutation, said method comprising:
 a) contacting said biological sample with a reagent comprising at least one polynucleotide that can specifically detect or specifically amplify an ALK resistance mutant polynucleotide having an ALK inhibitor resistance mutation, wherein said ALK resistance mutant polynucleotide encodes an ALK resistance mutant polypeptide that is resistant to PF-02341066, wherein said ALK resistance mutant polypeptide has a methionine residue at the position corresponding to amino acid residue position 1196 of SEQ ID NO:2; and,
 b) detecting the presence or absence of said ALK inhibitor resistance mutation in said biological sample, wherein the presence of said ALK inhibitor resistance mutation is indicative of said patient having a cancer that is resistant to or likely to develop resistance to PF-02341066.

45. The method of embodiment 44, wherein said ALK resistance mutant polynucleotide comprises a polynucleotide selected from the group consisting of:
 a) a polynucleotide having the nucleotide sequence set forth in SEQ ID NO: 23, 51, or 83;
 b) a polynucleotide encoding the amino acid sequence set forth in SEQ ID NO:24, 52, or 84; and,
 c) a polynucleotide having at least 90% sequence identity to SEQ ID NO: 23, 51, or 83, or a polynucleotide encoding an amino acid sequence having at least 90% sequence identity to SEQ ID NO:24, 52, or 84, wherein said polynucleotide encodes a polypeptide having a methionine residue at the position corresponding to amino acid residue position 1123 of SEQ ID NO:2, and wherein the polynucleotide encodes a polypeptide having kinase activity that is resistant to PF-02341066.

46. A method for diagnosing a cancer that is resistant to or likely to develop resistance to PF-02341066 in a subject comprising assaying a biological sample from said subject for the presence of an ALK oncogenic fusion protein having an ALK inhibitor resistance mutation, said method comprising:
 a) contacting said biological sample with an antibody that specifically binds an ALK oncogenic fusion protein comprising a polypeptide selected from the group consisting of:
  i) the amino acid sequence set forth in SEQ ID NO:52; and
  ii) an amino acid sequence having at least 90% sequence identity to SEQ ID NO:52, wherein the polypeptide has kinase activity that is resistant to PF-02341066; and,
 b) detecting binding of said antibody to said ALK oncogenic fusion protein having an ALK resistance mutation; wherein the presence of said ALK oncogenic fusion protein having an ALK inhibitor resistance mutation is indicative of said subject having a cancer that is resistant to or likely to develop resistance to PF-02341066.

47. A method for diagnosing a cancer that is resistant to or likely to develop resistance to PF-02341066 in a subject comprising assaying a biological sample from said subject for the presence of a polynucleotide encoding an ALK oncogenic fusion protein having an ALK inhibitor resistance mutation, said method comprising:
  a) contacting said biological sample with a reagent comprising at least one polynucleotide that can specifically detect or specifically amplify a polynucleotide encoding an ALK oncogenic fusion protein wherein said polynucleotide encoding an ALK oncogenic fusion protein comprises a polynucleotide selected from the group consisting of:
    i) a polynucleotide having the nucleotide sequence set forth in SEQ ID NO: 51;
    ii) a polynucleotide encoding the amino acid sequence set forth in SEQ ID NO:52; and,
    iii) a polynucleotide having at least 90% sequence identity to SEQ ID NO:51, or a polynucleotide encoding an amino acid sequence having at least 90% sequence identity to SEQ ID NO:52, wherein said polynucleotide encodes a polypeptide having a methionine residue at the position corresponding to amino acid residue position 1123 of SEQ ID NO:2, and wherein the polynucleotide encodes a polypeptide having kinase activity that is resistant to PF-02341066; and,
  b) detecting the presence or absence of said polynucleotide encoding an ALK oncogenic fusion protein having said ALK inhibitor resistance mutation in said biological sample; wherein the presence of said polynucleotide encoding said ALK oncogenic fusion protein having said ALK inhibitor resistance mutation is indicative of said subject having a cancer that is resistant to or likely to develop resistance to PF-02341066.

48. The method of embodiment 46 or 47, wherein said ALK oncogenic fusion protein comprises an ALK oncogenic fusion protein partner selected from the group consisting of nucleophosmin (NPM), non-muscle tropomyosin 3 (TPM3), 5-aminoimidazole-4-carboxamide ribonucleotide formyltransferase/IMP cyclohydrolase (ATIC), clathrin heavy chain (CLTC), TRK-fused gene (TFG), non-muscle tropomyosin 4 (TPM4), moesin (MSN), Ran-binding protein 2 (RanBP2), echinoderm microtubule-associated protein-like 4 (EML4), cysteinyl-tRNA synthetase (CARS), kinesin family member 5B (KIF5B), non-muscle myosin heavy chain 9 (MYH9), SEC31 homolog A (SEC31L1), and ring finger protein 213 (RNF213)/ALK lymphoma oligomerization partner on chromosome 17 (ALO17).

49. The method of embodiment 48, wherein said oncogenic fusion protein partner has the amino acid sequence set forth in SEQ ID NO:97.

50. The method of any one of embodiments 32-34, 36, 44, 45, and 47, wherein detecting said polynucleotide comprises a nucleic acid sequencing technique, a nucleic acid amplification method, or a nucleic acid hybridization technique.

51. The method of any one of embodiments 31, 33, 35, 36, and 39-49, wherein said cancer is selected from the group consisting of a large B-cell lymphoma, anaplastic large cell lymphoma (ALCL), malignant histiocytosis, an inflammatory myofibroblastic tumor sarcoma, an esophageal squamous cell carcinoma, a breast cancer, a colorectal carcinoma, a non-small cell lung carcinoma, a neuroblastoma, a bladder cancer, a renal cancer, and a glioblastoma.

52. The method of any one of embodiments 31, 33, 35, 36, and 39-49, further comprising selecting a therapy for said patient.

53. A method of specifically reducing the expression of an ALK resistance mutant that is resistant to at least one ALK small-molecule kinase inhibitor, said method comprising introducing into a cell expressing said ALK resistance mutant a silencing element that targets a gene encoding said ALK resistance mutant, wherein the introduction or expression of said silencing element specifically reduces the expression of said ALK resistance mutant, wherein said ALK resistance mutant is the polypeptide of any one of embodiments 12-20.

54. A method of treating a cancer associated with aberrant ALK activity that is resistant to at least one ALK small-molecule kinase inhibitor, said method comprising administering an effective amount of a silencing element that targets a gene encoding an ALK resistance mutant that is resistant to said at least one ALK small-molecule kinase inhibitor, wherein the introduction or expression of said silencing element reduces the expression of said ALK resistance mutant, wherein said ALK resistance mutant is the polypeptide of any one of embodiments 12-20.

55. A method of treating a cancer associated with aberrant ALK activity that is resistant to PF-02341066, said method comprising administering an effective amount of a silencing element that targets a gene encoding an ALK resistance mutant that is resistant to PF-02341066, wherein the introduction or expression of said silencing element reduces the expression of said ALK resistance mutant, wherein said ALK resistance mutant is a polypeptide comprising an amino acid sequence selected from the group consisting of:
  a) the amino acid sequence set forth in SEQ ID NO:24; and
  b) an amino acid sequence having at least 90% sequence identity to SEQ ID NO:24, wherein the polypeptide has a methionine residue at the position corresponding to amino acid residue position 1196 of SEQ ID NO:2, and wherein the polypeptide has kinase activity that is resistant to PF-02341066.

56. The method of embodiment 55, wherein said polypeptide comprises an amino acid sequence selected from the group consisting of:
  a) the amino acid sequence set forth in SEQ ID NO:52; and
  b) an amino acid sequence having at least 90% sequence identity to SEQ ID NO:52, wherein the polypeptide has kinase activity that is resistant to PF-02341066.

57. The method of embodiment 56, wherein said polypeptide further comprises an ALK oncogenic fusion protein partner, thus comprising an ALK oncogenic fusion protein.

58. The method of embodiment 55, wherein said polypeptide comprises an amino acid sequence selected from the group consisting of:
  a) the amino acid sequence set forth in SEQ ID NO:84; and
  b) an amino acid sequence having at least 90% sequence identity to SEQ ID NO:84, wherein the polypeptide has kinase activity that is resistant to PF-02341066.

59. The method of any one of embodiments 54-58, wherein said cancer is selected from the group consisting of a large B-cell lymphoma, anaplastic large cell lymphoma (ALCL), malignant histiocytosis, an inflammatory myofibroblastic tumor sarcoma, an esophageal squamous cell carcinoma, a breast cancer, a colorectal carcinoma, a non-small cell lung carcinoma, a neuroblastoma, a bladder cancer, a renal cancer, and a glioblastoma.

60. A method of identifying an agent capable of inhibiting the kinase activity of an ALK resistance mutant or ALK fusion protein comprising:

a) contacting a candidate agent with the polypeptide of any one of embodiments 12-20; and,
b) determining whether said candidate agent inhibits the kinase activity of said polypeptide.

61. The method of embodiment 60, wherein said polypeptide is expressed in a eukaryotic cell; wherein said polypeptide is the polypeptide of any one of embodiments 15-17; and wherein determining whether said agent inhibits the kinase activity of said polypeptide comprises monitoring said cell for at least one change in cellular activity selected from the group consisting of:
   a) inhibition of cell growth;
   b) stimulation of cell death;
   c) inhibition of anchorage independent growth; and,
   d) inhibition of cell migration or invasion;
wherein an agent that induces at least one of said changes in cellular activity is identified as an inhibitor of the ALK resistance mutant.

62. The method of embodiment 60, wherein a non-human animal has been altered to express said polypeptide or wherein eukaryotic cells expressing said polypeptide have been introduced into a non-human animal; wherein said polypeptide is the polypeptide of any one of embodiments 15-17; wherein determining whether said agent inhibits the kinase activity of said polypeptide comprises monitoring said non-human animal for tumor growth; and wherein a reduction in tumor growth is indicative of an agent that inhibits the kinase activity of said polypeptide.

63. The method of embodiment 60, wherein said polypeptide is expressed in a eukaryotic cell; wherein said polypeptide is the isolated polypeptide of embodiment 12 or 18; wherein the kinase activity of said polypeptide is activated; and wherein determining whether said agent inhibits the kinase activity of said polypeptide comprises monitoring said cell for at least one change in cellular activity selected from the group consisting of:
   a) inhibition of cell growth;
   b) stimulation of cell death;
   c) inhibition of anchorage independent growth; and,
   d) inhibition of cell migration or invasion;
wherein an agent that induces at least one of said changes in cellular activity is identified as an inhibitor of the ALK resistance mutant.

64. A method of identifying an agent capable of specifically binding a polypeptide of any one of embodiments 12-20 comprising the steps of:
   a) contacting a candidate agent with said polypeptide of any one of embodiments 13-21; and,
   b) determining whether said candidate agent specifically binds said polypeptide.

65. The method of embodiment 64, wherein said polypeptide is in an active or inactive state.

These and other aspects of the invention are disclosed in more detail in the description of the invention given below.

DETAILED DESCRIPTION OF THE INVENTION

Figure 1:
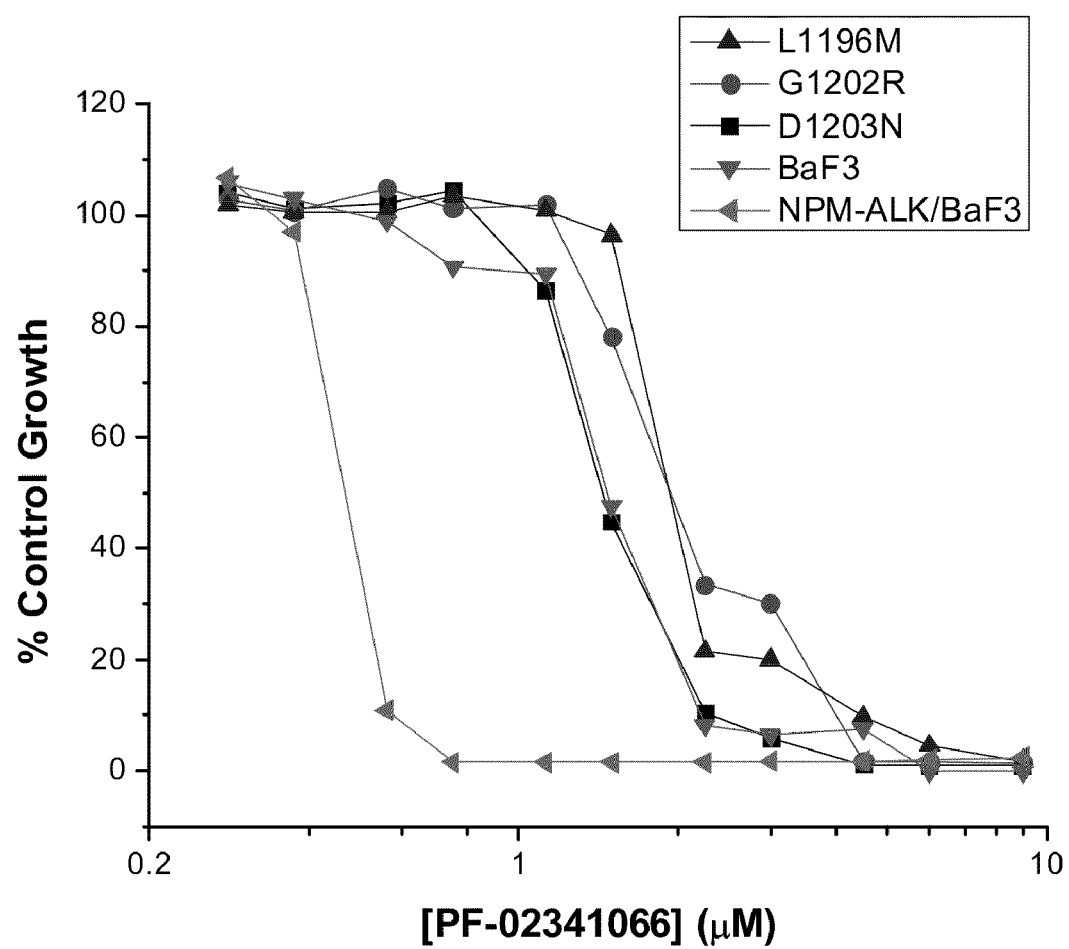
FIG. 1 shows the results of death curves in response to PF-02341066 that were performed as previously described (Lagisetti et al. (2009) *J Med Chem* 52:6979-6990) with a 72-hour XTT assay on BaF3 cell clones expressing either native NPM-ALK ("NPM-ALK/BaF3") or NPM-ALK engineered to contain one of three inhibitor resistance mutations (L1196M, G1202R, or D1203N) in the kinase domain. Parental BaF3 cells ("BaF3") were also tested as a normal, non-ALK-dependent cell control. $IC_{50}$ values of PF-02341066 for each of the cell clones can be found in Table 3.

Compositions of the invention include ALK polypeptides, polynucleotides encoding the same, and variants and fragments thereof that are resistant to ALK small-molecule kinase inhibitors. ALK or anaplastic lymphoma kinase, which is also known as cluster designation CD246, is a member of the insulin receptor superfamily of receptor tyrosine kinases. The ALK polypeptide is a single-chain transmembrane protein comprising an extracellular ligand-binding region, a transmembrane-spanning domain, and a cytoplasmic kinase catalytic region. ALK is encoded by a genomic locus found at the chromosomal band 2p23 in the human (Morris et al. (1994) *Science* 263:1281-1284; Shiota et al. (1994) *Oncogene* 9:1567-1574), and on the distal mouse chromosome 17 (Mathew et al. (1995) *Cytogenet. Cell. Genet.* 70:143-144).

ALK polynucleotides and polypeptides are known in the art for various species. The genomic sequence for human ALK is set forth in Genbank accession number NC_000002.11. The coding sequence for human ALK can be found in Genbank accession number U62540 and is set forth in SEQ ID NO: 1 and the encoded human ALK polypeptide is set forth in SEQ ID NO: 2. Mouse and *Drosophila* ALK cDNA have Genbank accession numbers of D83002 and AAF36990, respectively. Human ALK is a 1620-amino acid (aa) polypeptide, whereas the mouse ALK is 1621 aa in length and the fruit fly ALK polypeptide is 1701 aa. The human ALK cDNA codes for a polypeptide of 177-kDa, but with post-translational modifications, such as N-glycosylation, the mature ALK is approximately 200-220 kDa.

ALK polypeptides comprise a variety of conserved structural domains. The 1030-amino acid long extracellular domain of human ALK contains several motifs, including a 26 amino acid amino-terminal signal peptide sequence, and the binding sites (located at residues 391-401) for the endogenous ligands pleiotrophin and midkine. The 28-amino acid transmembrane domain (located at residues 1031-1058 of SEQ ID NO:2) is followed by a 64-amino acid cytoplasmic juxtamembrane segment that comprises a binding site (located at residues 1093-1096) for phosphotyrosine-dependent interaction with the IR substrate-1. The minimal kinase domain (residues 1116-1383) includes a three tyrosine-containing motif (tyrosines 1278, 1282, and 1283) within its activation loop. These tyrosine residues are autophosphorylation sites that regulate the activation loop conformation, blocking access of ATP to the ATP-binding pocket in its nonphosphorylated state and swinging outward and away from the binding pocket to allow unimpeded entry of ATP during the kinase-activation process following phosphorylation of the triplet tyrosines (Tartani et al. (2008) *J Biol Chem* 283:3743-3750). While residues 1116-1383 of ALK encompass the minimal kinase domain, residues E1406 and E1408 are required for optimal activity and are considered part of the extended kinase domain. The 244-amino acid ALK carboxy terminus contains a phosphotyrosine-dependent binding site (residues 1504-1507) for the substrate protein Src homology 2 domain containing (SHC) and an interaction site (residues 1603-1606) for the phosphotyrosine-dependent binding of phospholipase C-γ.

The nervous system-predominant expression profile of ALK suggests that the kinase plays a role in the development or functioning of the nervous system; however, ALK knockout mice are viable and exhibit no readily obvious abnormalities (Iwahara et al. (1997) *Oncogene* 14:439-449; Morris et al.

(1997) *Oncogene* 14:2175-2188; Loren et al. (2001) *Genes Cells* 6:531-544; Pulford et al. (1997) *Blood* 89:1394-1404). Further studies of ALK knockout mice revealed that the mice display an "antidepressant profile", suggesting that ALK may be involved in the pathophysiology of cognitive and/or mood disorders (Bilsland et al. (2008) *Neuropsychopharmacology* 33:684-700).

Although genomic DNA amplification and protein overexpression, as well as activating point mutations, of ALK have been shown to cause neuroblastomas (Webb et al. (2009) *Expert Rev Anticancer Ther* 9:331-356; George et al. (2008) *Nature* 455:975-979) and full-length ALK has been implicated in the genesis of yet other malignancies, such as glioblastoma (Webb et al. (2009) *Expert Rev Anticancer Ther* 9:331-356), most cancers associated with aberrant ALK activity are due to the formation of oncogenic ALK fusion proteins that exhibit constitutive kinase activity. Thus, ALK polynucleotides and polypeptides useful in methods for detecting the presently disclosed resistance mutations, in diagnosing those cancers that are resistant or likely to develop resistance to ALK kinase inhibitors, and in methods for identifying agents that specifically bind to and/or inhibit the activity of ALK or ALK oncogenic fusion proteins comprising the resistance mutations include those that comprise the kinase domain, the full-length ALK, or the ALK oncogenic fusion proteins.

An "ALK oncogenic fusion" or "ALK oncogenic fusion protein" is a polypeptide comprising an amino terminal fusion partner and a fragment of the ALK polypeptide at the carboxy terminus. The fusion of the two proteins results in the constitutive activation of the kinase activity of ALK through oligomerization mediated by an oligomerization domain in the amino terminal fusion partner and subsequent constitutive transmission of growth-promoting cellular signals. ALK activation causes increased cell proliferation and apoptosis at least partially due to activation of the protein kinase C (PKC), mitogen-activated protein kinase (MAPK) and phosphoinositide 3-kinase (PI3K) pathways. In addition, activation of ALK enhances cell migration and invasion and promotes anchorage independent growth of cells. In some embodiments, the amino-terminal partner protein is one that is widely expressed in normal cells and its promoter is responsible for the aberrant expression of the encoded fusion protein. Naturally-occurring ALK oncogenic fusions are the result of chromosomal translocations.

As used herein, "ALK oncogenic fusion partner" or "ALK oncogenic fusion protein partner" refers to the amino-terminal fragment of the ALK oncogenic fusion comprising an oligomerization domain.

Naturally-occurring oncogenic fusion partners are known in the art and include, but are not limited to, nucleophosmin (NPM), non-muscle tropomyosin 3 (TPM3), 5-aminoimidazole-4-carboxamide ribonucleotide formyltransferase/IMP cyclohydrolase (ATIC), clathrin heavy chain (CLTC), TRK-fused gene (TFG), non-muscle tropomyosin 4 (TPM4), moesin (MSN), Ran-binding protein 2 (RanBP2), echinoderm microtubule-associated protein-like 4 (EML4), cysteinyl-tRNA synthetase (CARS), kinesin family member 5B (KIF5B), non-muscle myosin heavy chain 9 (MYH9), SEC31 homolog A (SEC31L1), and ring finger protein 213 (RNF213)/ALK lymphoma oligomerization partner on chromosome 17 (ALO17) (see Webb et al. (2009) *Expert Rev Anticancer Ther* 9:331-356, which is herein incorporated by reference in its entirety, for review). Table 1 provides accession numbers for the genomic and coding sequences of each ALK oncogenic fusion partner, along with reference to the coding sequence of the fragment that fuses with ALK.

TABLE 1

ALK oncogenic fusion partners.

| Name | Genomic DNA Acc. No. | Coding sequence Acc. No. | SEQ ID NO: of coding sequence for ALK oncogenic partner fusion fragment |
|---|---|---|---|
| ALO17/RNF213 | NT_010783 | NM_020914 | 108 |
| ATIC | NT_005403 | NM_004044 | 109 |
| CARS | NT_009237 | NM_001014437 | 110 |
| CLTC | NT_010783 | NM_004859 | 111 |
| EML4 variant 1 | NT_022184 | NM_019063 | 112 |
| EML4 variant 2 | NT_022184 | NM_019063 | 113 |
| EML4 variant 3a | NT_022184 | NM_019063 | 114 |
| EML4 variant 3b | NT_022184 | NM_019063 | 115 |
| EML4 variant 4 | NT_022184 | NM_019063 | 116 |
| EML4 variant 5 | NT_022184 | NM_019063 | 117 |
| EML4 variant 5a | NT_022184 | NM_019063 | 118 |
| EML4 variant 5b | NT_022184 | NM_019063 | 119 |
| EML4 variant 6 | NT_022184 | NM_019063 | 120 |
| EML4 variant 7 | NT_022184 | NM_019063 | 121 |
| KIF5B | NT_008705 | NM_004521 | 122 |
| MSNa | NT_011669 | NM_002444 | 123 |
| MSNb | NT_011669 | NM_002444 | 124 |
| MYH9 | NT_011520 | NM_002473 | 125 |
| NPM | NT_034772 | NM_002520 | 126 |
| RanBP2 | NT_022171 | NM_006267 | 127 |
| SEC31L1 Type 1 | NT_016354 | NM_014933 | 128 |
| SEC31L1 Type 2 | NT_016354 | NM_014933 | 129 |
| $TFG_S$ | NT_005612 | NM_006070 | 130 |
| $TFG_L$ | NT_005612 | NM_006070 | 131 |
| $TFG_{SXL}$ | NT_005612 | NM_006070 | 132 |
| TPM3 | NT_004487 | NM_152263 | 133 |
| TPM4 Type 1 | NT_011295 | NM_003290 | 134 |
| TPM4 Type 2 | NT_011295 | NM_003290 | 135 |

Approximately sixty percent of anaplastic large cell lymphomas (ALCL) and about 60% of inflammatory myofibroblastic tumors (IMTs), a slow-growing sarcoma that mainly affects children and young adults, have the NPM-ALK fusion protein. (Armitage et al. (2001) Cancer: Principle and Practice of Oncology, 6th edition, 2256-2316; Kutok and Aster (2002) *J. Clin. Oncol.* 20:3691-3702; Lawrence et al. (2000) *Am. J. Pathol.* 157:377-384). The nucleotide and amino acid sequence of the NPM-ALK fusion is set forth in SEQ ID NOs: 3 and 4, respectively, and the fragment of NPM that is fused to ALK in NPM-ALK oncogenic fusion proteins is set forth in SEQ ID NO:97. Except for MSN-ALK and TPM3/TPM4-ALK (which differ only slightly from all other ALK fusions with respect to the portion of ALK incorporated into them), all known chimeric ALK proteins contain the entire intracytoplasmic portion of ALK, corresponding to amino acid residues 1058-1620 of ALK (SEQ ID NO:2). Such a fragment of ALK is referred to herein as an "ALK fusion fragment".

Described herein are ALK mutants that are resistant to ALK kinase inhibitors, which are also referred to herein as ALK inhibitor resistance mutants or ALK resistance mutants. ALK resistance mutant polypeptides include the amino acid sequences set forth in SEQ ID NOs: 6, 8, 10, 12, 14, 16, 18, 20, 22, 26, 28, 30, 32 (mutated ALK kinase domains); SEQ ID NOs: 34, 36, 38, 40, 42, 44, 46, 48, 50, 54, 56, 58, 60, 62, 64 (mutated ALK fusion fragments); and SEQ ID NOs: 66, 68, 70, 72, 74, 76, 78, 80, 82, 86, 88, 90, 92, 94, and 96 (mutated full-length ALK polypeptides) and variants and fragments thereof. Likewise, ALK resistance mutant polynucleotides include the nucleotide sequences set forth in SEQ ID NOs: 5, 7, 9, 11, 13, 15, 17, 19, 21, 25, 27, 29, 31 (mutated ALK kinase domains); SEQ ID NOs: 33, 35, 37, 39, 41, 43, 45, 47, 49, 53, 55, 57, 59, 61, 63 (mutated ALK fusion fragments); and SEQ ID NOs: 65, 67, 69, 71, 73, 75, 77, 79, 81, 85, 87, 89, 91, 93, and 95 (mutated full-length ALK polynucleotides) and variants and fragments thereof as well as polynucleotides that encode the ALK resistance mutant polypeptides set forth in SEQ ID NOs: 6, 8, 10, 12, 14, 16, 18, 20, 22, 26, 28, 30, 32, 34, 36, 38, 40, 42, 44, 46, 48, 50, 54, 56, 58, 60, 62, 64, 66, 68, 70, 72, 74, 76, 78, 80, 82, 86, 88, 90, 92, 94, and 96 and variants and fragments thereof.

An "ALK resistance mutation" or "ALK inhibitor resistance mutation" is a change in the nucleotide sequence or amino acid sequence of native ALK that confers resistance of the ALK polypeptide to at least one ALK kinase inhibitor. The identified ALK resistance mutations (which are point mutations resulting in a substitution of a single amino acid residue) at both the polynucleotide and polypeptide levels are disclosed in Table 1. It is understood that additional polynucleotide mutations may result in the same amino acid substitution due to codon degeneracy.

As used herein, the term "polynucleotide" is intended to encompass a singular nucleic acid, as well as plural nucleic acids, and refers to a nucleic acid molecule or construct, e.g., messenger RNA (mRNA), plasmid DNA (pDNA), or short interfering RNA (siRNA). A polynucleotide can be single-stranded or double-stranded, linear or circular and can be comprised of DNA, RNA, or a combination thereof. A polynucleotide can comprise a conventional phosphodiester bond or a non-conventional bond (e.g., an amide bond, such as found in peptide nucleic acids (PNA)). The term "nucleic acid" refers to any one or more nucleic acid segments, e.g., DNA or RNA fragments, present in a polynucleotide. The "polynucleotide" can contain modified nucleic acids, such as phosphorothioate, phosphate, ring atom modified derivatives, and the like. The "polynucleotide" can be a naturally occurring polynucleotide (i.e., one existing in nature without human intervention), a recombinant polynucleotide (i.e., one existing only with human intervention), or a synthetically derived polynucleotide.

Polynucleotides can encode a polypeptide or protein. By "encoding" or "encoded," with respect to a specified nucleic acid, is meant comprising the information for transcription into a RNA and in some embodiments, translation into the specified protein. A nucleic acid encoding a protein may comprise non-translated sequences (e.g., introns) within translated regions of the nucleic acid, or may lack such intervening non-translated sequences (e.g., as in cDNA). The information by which a protein is encoded is specified by the use of codons. Typically, the amino acid sequence is encoded by the nucleic acid using the "universal" genetic code. However, variants of the universal code, such as is present in some plant, animal, and fungal mitochondria, the bacterium *Mycoplasma capricolumn* (Yamao, et al., (1985) *Proc. Natl. Acad. Sci. USA* 82:2306-9) or the ciliate Macronucleus, may be used when the nucleic acid is expressed using these organisms.

As used herein, the term "polypeptide" or "protein" is intended to encompass a singular "polypeptide" as well as plural "polypeptides," and refers to a molecule composed of monomers (amino acids) linearly linked by amide bonds (also known as peptide bonds). The term "polypeptide" refers to any chain or chains of two or more amino acids, and does not refer to a specific length of the product. Thus, peptides, dipeptides, tripeptides, oligopeptides, "protein," "amino acid chain," or any other term used to refer to a chain or chains of two or more amino acids, are included within the definition of "polypeptide," and the term "polypeptide" can be used instead of, or interchangeably with any of these terms.

An "isolated" or "purified" polynucleotide or protein, or biologically active portion thereof, is substantially or essentially free from components that normally accompany or interact with the polynucleotide or protein as found in its naturally occurring environment. Thus, an isolated or purified polynucleotide or protein is substantially free of other cellular material, or culture medium when produced by recombinant techniques, or substantially free of chemical precursors or other chemicals when chemically synthesized. Optimally, an "isolated" polynucleotide is free of sequences (optimally protein encoding sequences) that naturally flank the polynucleotide (i.e., sequences located at the 5' and 3' ends of the polynucleotide) in the genomic DNA of the organism from which the polynucleotide is derived. For example, in various embodiments, the isolated polynucleotide can contain less than about 5 kb, 4 kb, 3 kb, 2 kb, 1 kb, 0.5 kb, or 0.1 kb of nucleotide sequence that naturally flank the polynucleotide in genomic DNA of the cell from which the polynucleotide is derived. A protein that is substantially free of cellular material includes preparations of protein having less than about 30%, 20%, 10%, 5%, or 1% (by dry weight) of contaminating protein. When the protein of the invention or biologically active portion thereof is recombinantly produced, optimally culture medium represents less than about 30%, 20%, 10%, 5%, or 1% (by dry weight) of chemical precursors or non-protein-of-interest chemicals.

Fragments and variants of the polynucleotides encoding the ALK resistance mutant polypeptides and fragments and variants of the polypeptides themselves can be employed in the various methods and compositions of the invention, including biologically active variants and fragments of the ALK resistance mutant polypeptides. Such active variants and fragments will retain a functional kinase domain that is resistant to at least one ALK kinase inhibitor. Methods to assay for kinase activity are known and are described elsewhere herein.

By "fragment" is intended a portion of the polynucleotide and hence the protein encoded thereby or a portion of the polypeptide. Fragments of a polynucleotide may encode protein fragments that retain the biological activity of the ALK resistance mutant protein and hence have kinase activity that is resistant to at least one ALK kinase inhibitor. Thus, fragments of a polynucleotide may range from at least about 20 nucleotides, about 50 nucleotides, about 100 nucleotides, about 150, about 200, about 250, about 300, about 350, about 400, about 450, about 500, about 600, about 700, about 800, about 900, about 1000, about 1500, about 2000, about 2500, about 3000, about 3500, about 4000, about 4500 contiguous nucleotides, and up to the full-length polynucleotide encoding the ALK resistance mutant polypeptide.

A fragment of a polynucleotide that encodes a biologically active portion of an ALK resistance mutant polypeptide will encode at least about 15, about 25, about 30, about 50, about 100, about 150, about 200, about 250, about 300, about 350, about 400, about 450, about 500, about 600, about 700, about 800, about 900, about 1000, about 1100, about 1200, about 1300, about 1400, about 1500, about 1600 contiguous amino acids, or up to the total number of amino acids present in a full-length ALK resistance mutant polypeptide.

A biologically active portion of an ALK resistance mutant polypeptide can be prepared by isolating a portion of one of the polynucleotides encoding the portion of the ALK resistance mutant polypeptide and expressing the encoded portion of the polypeptide (e.g., by recombinant expression in vitro), and assessing the activity of the portion of the ALK polypeptide. Polynucleotides that encode fragments of an ALK resistance mutant polypeptide can comprise nucleotide sequences comprising at least 15, 20, 50, 75, 100, 150, 200, 250, 300, 350, 400, 450, 500, 550, 600, 650, 700, 800, 900, 1000, 1500, 2000, 2500, 3000, 3500, 4000, 4500 contiguous nucleotides, or up to the number of nucleotides present in a full-length ALK resistance mutant nucleotide sequence disclosed herein.

"Variant" sequences have a high degree of sequence similarity. For polynucleotides, conservative variants include those sequences that, because of the degeneracy of the genetic code, encode the amino acid sequence of one of the ALK resistance mutant polypeptides. Variants such as these can be identified with the use of well-known molecular biology techniques, such as, for example, polymerase chain reaction (PCR) and hybridization techniques. Variant polynucleotides also include synthetically derived nucleotide sequences, such as those generated, for example, by using site-directed mutagenesis, but which still encode an ALK resistance mutant polypeptide. Generally, variants of a particular polynucleotide will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to that particular polynucleotide as determined by sequence alignment programs and parameters described elsewhere herein.

Variants of a particular polynucleotide can also be evaluated by comparison of the percent sequence identity between the polypeptide encoded by a variant polynucleotide and the polypeptide encoded by the reference polynucleotide. Thus, variants include, for example, isolated polynucleotides that encode a polypeptide with a given percent sequence identity to the ALK polypeptides set forth herein. Percent sequence identity between any two polypeptides can be calculated using sequence alignment programs and parameters described herein. Where any given pair of polynucleotides is evaluated by comparison of the percent sequence identity shared by the two polypeptides they encode, the percent sequence identity between the two encoded polypeptides is at least about 40%, 45%, 50%, 55%, 60%, 65%, 70%, 75%, 80%, 85%, 90%, 91%, 92%, 93%, 94%, 95%, 96%, 97%, 98%, 99% or more sequence identity.

By "variant" polypeptide is intended a polypeptide derived from the ALK resistance mutant polypeptide by deletion (so-called truncation) or addition of one or more amino acids to the N-terminal and/or C-terminal end of the polypeptide; deletion or addition of one or more amino acids at one or more sites in the polypeptide; or substitution of one or more amino acids at one or more sites in the polypeptide. Variant ALK resistance mutant polypeptides are biologically active, that is they continue to have kinase activity that is resistant to at least one ALK kinase inhibitor. Such variants may result from, for example, genetic polymorphism or from human manipulation. Biologically active variants of an ALK resistance mutant polypeptide will have at least about 40%, 45%, 50%, 55%, 60%, 65%, 70%, 75%, 80%, 85%, 90%, 91%, 92%, 93%, 94%, 95%, 96%, 97%, 98%, 99% or more sequence identity to the amino acid sequence for the ALK resistance mutant polypeptide as determined by sequence alignment programs and parameters described elsewhere herein. A biologically active variant of a polypeptide may differ from that polypeptide by as few as 1-15 amino acid residues, as few as 1-10, such as 6-10, as few as 5, as few as 4, 3, 2, or even 1 amino acid residue.

Biologically active variants and fragments of ALK resistance mutant polypeptides retain the point mutation responsible for the resistance to at least one ALK kinase inhibitor. Therefore, variants and fragments of ALK resistance mutant polypeptides comprise at least one of the following amino acid residues:

a) a serine residue or a conservative substitution thereof at the position corresponding to amino acid residue position 1123 of SEQ ID NO:2;

b) an alanine residue or a conservative substitution thereof at the position corresponding to amino acid residue position 1123 of SEQ ID NO:2;

c) a valine residue or a conservative substitution thereof at the position corresponding to amino acid residue position 1129 of SEQ ID NO:2;

d) a lysine residue or a conservative substitution thereof at the position corresponding to amino acid residue position 1132 of SEQ ID NO:2;

e) a methionine residue or a conservative substitution thereof at the position corresponding to amino acid residue position 1151 of SEQ ID NO:2;

f) a tyrosine residue or a conservative substitution thereof at the position corresponding to amino acid residue position 1156 of SEQ ID NO:2;

g) a cysteine residue or a conservative substitution thereof at the position corresponding to amino acid residue position 1174 of SEQ ID NO:2;

h) an isoleucine residue or a conservative substitution thereof at the position corresponding to amino acid residue position 1174 of SEQ ID NO:2;

i) a valine residue or a conservative substitution thereof at the position corresponding to amino acid residue position 1174 of SEQ ID NO:2;

j) a leucine residue or a conservative substitution thereof at the position corresponding to amino acid residue position 1174 of SEQ ID NO:2;

k) a methionine residue or a conservative substitution thereof at the position corresponding to amino acid residue position 1196 of SEQ ID NO:2 l) an arginine residue or a conservative substitution thereof at the position corresponding to amino acid residue position 1202 of SEQ ID NO:2;

m) an asparagine residue or a conservative substitution thereof at the position corresponding to amino acid residue position 1203 of SEQ ID NO:2;

n) a lysine residue or a conservative substitution thereof at the position corresponding to amino acid residue position 1210 of SEQ ID NO:2;

o) an alanine residue or a conservative substitution thereof at the position corresponding to amino acid residue position 1269 of SEQ ID NO:2;

p) a lysine residue or a conservative substitution thereof at the position corresponding to amino acid residue position 1406 of SEQ ID NO:2; and, q) a lysine residue or a conservative substitution thereof at the position corresponding to amino acid residue position 1408 of SEQ ID NO:2.

Likewise, variant ALK resistance mutant polynucleotides can be one that encodes such a variant ALK resistance mutant polypeptide.

As used herein, a "conservative substitution" of an amino acid residue comprises other amino acid residues that are similar in size and/or charge to another amino acid residue. The conservative substitution of the amino acid residue does not encompass amino acid residues that are found at that particular position within the native ALK sequence (disclosed in SEQ ID NO:2).

As used herein, an amino acid residue of an ALK mutant polypeptide at the position corresponding to a particular amino acid residue of native ALK (SEQ ID NO:2) refers to the amino acid residue within the ALK mutant polypeptide that appears opposite the amino acid residue at a particular position in the native ALK sequence when the ALK mutant sequence is aligned with the native ALK sequence (SEQ ID NO:2) for maximum homology using an alignment program, such as one known in the art (e.g., the GAP program in the GCG software package, using either a BLOSUM62 matrix or a PAM250 matrix).

Polypeptides may be altered in various ways including amino acid substitutions, deletions, truncations, and insertions. Methods for such manipulations are generally known in the art. For example, amino acid sequence variants of the ALK resistance mutant polypeptides can be prepared by mutations in the DNA. Methods for mutagenesis and nucleotide sequence alterations are well known in the art. See, for example, Kunkel (1985) *Proc. Natl. Acad. Sci. USA* 82:488-492; Kunkel et al. (1987) *Methods in Enzymol.* 154:367-382; U.S. Pat. No. 4,873,192; Walker and Gaastra, eds. (1983) *Techniques in Molecular Biology* (MacMillan Publishing Company, New York) and the references cited therein. Guidance as to appropriate amino acid substitutions that do not affect biological activity of the polypeptide of interest may be found in the model of Dayhoff et al. (1978) *Atlas of Protein Sequence and Structure* (Natl. Biomed. Res. Found., Washington, D.C.), herein incorporated by reference. Conservative substitutions, such as exchanging one amino acid with another having similar properties, may be preferable.

Thus, the polynucleotides used in the invention can include naturally occurring sequences as well as those that are synthetically derived or modified. Likewise, the polypeptides used in the methods of the invention encompass naturally occurring polypeptides as well as variations and modified forms thereof. Generally, the mutations made in the polynucleotide encoding the variant polypeptide should not place the sequence out of reading frame, and/or create complementary regions that could produce secondary mRNA structure. See, EP Patent Application Publication No. 75,444.

The deletions, insertions, and substitutions of the polypeptide sequences encompassed herein are not expected to produce radical changes in the characteristics of the polypeptide. However, when it is difficult to predict the exact effect of the substitution, deletion, or insertion in advance of doing so, one skilled in the art will appreciate that the effect will be evaluated by routine screening assays.

Variant polynucleotides and polypeptides also encompass sequences and polypeptides derived from a mutagenic and recombinogenic procedure such as DNA shuffling. With such a procedure, one or more different ALK resistance mutant coding sequences can be manipulated to create a new ALK resistance mutant polypeptide possessing the desired properties. In this manner, libraries of recombinant polynucleotides are generated from a population of related sequence polynucleotides comprising sequence regions that have substantial sequence identity and can be homologously recombined in vitro or in vivo. Strategies for such DNA shuffling are known in the art. See, for example, Stemmer (1994) *Proc. Natl. Acad. Sci. USA* 91:10747-10751; Stemmer (1994) *Nature* 370:389-391; Crameri et al. (1997) *Nature Biotech.* 15:436-438; Moore et al. (1997) *J. Mol. Biol.* 272:336-347; Zhang et al. (1997) *Proc. Natl. Acad. Sci. USA* 94:4504-4509; Crameri et al. (1998) *Nature* 391:288-291; and U.S. Pat. Nos. 5,605,793 and 5,837,458.

As used herein, "sequence identity" or "identity" in the context of two polynucleotides or polypeptide sequences makes reference to the residues in the two sequences that are the same when aligned for maximum correspondence over a specified comparison window. When percentage of sequence identity is used in reference to proteins it is recognized that residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity". Means for making this adjustment are well known to those of skill in the art. Typically this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, Calif.).

As used herein, "percentage of sequence identity" means the value determined by comparing two optimally aligned sequences over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity.

Unless otherwise stated, sequence identity/similarity values provided herein refer to the value obtained using GAP Version 10 using the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix; or any equivalent program thereof. By "equivalent program" is intended any sequence comparison program that, for any two sequences in question, generates an alignment having identical nucleotide or amino acid residue matches and an identical percent sequence identity when compared to the corresponding alignment generated by GAP Version 10.

Disclosed herein are novel mutations within ALK that confer resistance to ALK kinase inhibitors. As used herein, an "ALK kinase inhibitor" is a compound that is capable of inhibiting the kinase activity of ALK polypeptides. In some embodiments, the ALK mutants are resistant to ALK small-molecule kinase inhibitors. As used herein, a "small molecule" refers to a chemical compound that is small enough in size so that it can readily pass through a cellular membrane unassisted. In general, a small molecule refers to chemical compounds that are not polymers, such as nucleic acids, polypeptides, or polysaccharides, although the term can encompass small polymers that are capable of readily crossing the cellular membrane.

The kinase activity of ALK refers to the ability of ALK to phosphorylate tyrosine residues of substrates, either naturally occurring or synthetic, including ALK itself and other downstream substrates (e.g., SHC). Upon oligomerization, ALK autophosphorylates three ALK tyrosine residues, which fully activates the enzyme, allowing ALK to phosphorylate additional substrates, such as SHC. ALK kinase inhibitors inhibit the kinase activity of ALK polypeptides, meaning that the kinase activity is partially or completely reduced in comparison to the kinase in the absence of the inhibitor compound. In some embodiments, the ALK kinase activity is reduced by the ALK kinase inhibitor by at least about 10%, about 20%, about 30%, about 40%, about 50%, about 60%, about 70%, about 80%, about 90%, about 95%, or about 100% when compared to the activity of the kinase in the absence of the inhibitor.

Methods for assaying the kinase activity of an ALK polypeptide are known in the art and include in vitro kinase assays wherein ALK polypeptides are isolated via affinity purification or immunoprecipitation and the autophosphorylation of ALK or the phosphorylation of a substrate protein or peptide is measured in the presence of ATP. Cell-based assays can also be used wherein ALK autophosphorylation or phosphorylation of an ALK substrate is determined using immunoblotting or an enzyme-linked immunoassay, for example. Non-limiting examples of methods for analyzing ALK kinase activity can be found in U.S. Application Publication Nos. 2008/0090776 and 2009/0099193, each which are herein incorporated by reference in its entirety.

ALK kinase inhibitors may bind to the inactive form of ALK, wherein the three tyrosine residues in the activation loop are unphosphorylated or to the active, autophosphorylated form of ALK. The ALK kinase inhibitors inhibit both the autophosphorylation of the kinase and the phosphorylation of additional substrates. In order to be clinically useful, many ALK kinase inhibitors are fairly specific for ALK, however, the term ALK kinase inhibitor encompasses inhibitors that are also capable of inhibiting other kinases, such as the MET kinase.

Non-limiting examples of ALK kinase inhibitors that are known in the art include PF-0234166 (Zou et al. (2007) *Cancer Res* 67:4408-4417; Christensen et al. (2007) *Mol Cancer Ther* 6:3314-3322; U.S. Application Publication No. 2008/0051419), NVP-TAE684 (Galkin et al. (2007) *Proc Natl Acad Sci USA* 104:270-275), staurosporine, 7-hydroxystaurosporine, CEP-14083, CEP-14513, CEP-28122 (Wan et al. (2006) *Blood* 107:1617-1623; Piva et al. (2006) *J Clin Invest* 116:3171-31821), pyridone 14 (Li et al. (2006) *J Med Chem* 49:1006-1015), pyridone 15, CRL151104A (U.S. Application Publication No. 2008/0171769), and WZ-5-126 (McDermott et al. (2008) *Cancer Res* 68:3389-3395), each of which are herein incorporated by reference in its entirety. In specific embodiments, the presently disclosed ALK resistance mutations confer resistance to PF-0234166.

The ALK resistance mutant polynucleotides can be found in an expression cassette. The expression cassettes can comprise one or more regulatory sequences that are operably linked to the ALK resistance mutant polynucleotide that facilitate expression of the polynucleotide. "Regulatory sequences" refer to nucleotide sequences located upstream (5' non-coding sequences), within, or downstream (3' non-coding sequences) of a coding sequence, and which influence the transcription, RNA processing or stability, or translation of the associated coding sequence. See, for example, Goeddel (1990) in *Gene Expression Technology Methods in Enzymology* 185 (Academic Press, San Diego, Calif.). Regulatory sequences may include promoters, translation leader sequences, introns, and polyadenylation recognition sequences.

Regulatory sequences are operably linked with a coding sequence to allow for expression of the polypeptide encoded by the coding sequence. "Operably linked" is intended to mean that the coding sequence is functionally linked to the regulatory sequence(s) in a manner that allows for expression of the nucleotide sequence. Operably linked elements may be contiguous or non-contiguous. Polynucleotides may be operably linked to regulatory sequences in sense or antisense orientation.

The regulatory regions (i.e., promoters, transcriptional regulatory regions, and translational termination regions) and/or the coding polynucleotides may be native/analogous to the cell to which the polynucleotide is being introduced or to each other. Alternatively, the regulatory regions and/or the coding polynucleotides may be heterologous to the cell to which the polynucleotide is being introduced or to each other.

As used herein, "heterologous" in reference to a sequence is a sequence that originates from a foreign species, or, if from the same species, is substantially modified from its native form in composition and/or genomic locus by deliberate human intervention. For example, a promoter operably linked to a heterologous polynucleotide is from a species different from the species from which the polynucleotide was derived, or, if from the same/analogous species, one or both are substantially modified from their original form and/or genomic locus, or the promoter is not the native promoter for the operably linked polynucleotide.

Regulatory sequences include those that direct constitutive expression of a nucleotide sequence in many types of host cells and those that direct expression of the nucleotide sequence only in certain host cells (e.g., tissue-specific regulatory sequences) or at particular stages of development/differentiation (e.g., development-specific regulatory sequences), or those that are chemically-induced. It will be appreciated by those skilled in the art that the design of the expression cassette can depend on such factors as the choice of the host cell to which the polynucleotide is to be introduced, the level of expression of the polypeptide desired, and the like. Such expression cassettes typically include one or more appropriately positioned sites for restriction enzymes, to facilitate introduction of the nucleic acid into a vector.

It will further be appreciated that appropriate promoter and/or regulatory elements can readily be selected to allow expression of the coding sequence in the cell of interest and at the particular developmental/differentiation state. In some embodiments, a promoter that is recognized by RNA polymerase II can be used.

The regulatory sequences can also be provided by viral regulatory elements. For example, commonly used promoters are derived from polyoma, Adenovirus 2, cytomegalovirus, and Simian Virus 40. For other suitable expression systems for eukaryotic cells, see Chapters 16 and 17 of Sambrook et al. (1989) *Molecular Cloning: A Laboratory Manual* (2d ed., Cold Spring Harbor Laboratory Press, Plainview, N.Y.). See, Goeddel (1990) in *Gene Expression Technology: Methods in Enzymology* 185 (Academic Press, San Diego, Calif.).

Various constitutive promoters are known. For example, in various embodiments, the human cytomegalovirus (CMV) immediate early gene promoter, the SV40 early promoter, the Rous sarcoma virus long terminal repeat, rat insulin promoter and glyceraldehyde-3-phosphate dehydrogenase can be used to obtain high-level expression of the coding sequence of interest. The use of other viral or mammalian cellular or bacterial phage promoters which are well-known in the art can be used to achieve expression of a coding sequence of interest. Promoters which may be used include, but are not limited to, the long terminal repeat as described in Squinto et al. (1991) *Cell* 65:1 20); the SV40 early promoter region (Bernoist and Chambon (1981) *Nature* 290:304 310), the CMV promoter, the M-MuLV 5' terminal repeat the promoter contained in the 3' long terminal repeat of Rous sarcoma virus (Yamamoto et al. (1980) *Cell* 22:787 797), and the herpes thymidine kinase promoter (Wagner et al. (1981) *Proc. Natl. Acad. Sci. U.S.A.* 78:144 1445).

Inducible promoters are also known. Non-limiting examples of inducible promoters and their inducer include MT II/phorbol Ester (TPA) (Palmiter et al. (1982) *Nature* 300:611) and heavy metals (Haslinger and Karin (1985) *Proc. Nat'l Acad. Sci. USA.* 82:8572; Searle et al. (1985) *Mol. Cell. Biol.* 5:1480; Stuart et al. (1985) *Nature* 317:828; Imagawa et al. (1987) *Cell* 51:251; Karin et al. (1987) *Mol. Cell. Biol.* 7:606; Angel et al. (1987) *Cell* 49:729; McNeall et al. (1989) *Gene* 76:8); MMTV (mouse mammary tumor virus)/glucocorticoids (Huang et al. (1981) *Cell* 27:245; Lee et al. (1981) *Nature* 294:228; Majors and Varmus (1983) *Proc. Nat'l Acad. Sci. USA.* 80:5866; Chandler et al. (1983) *Cell* 33:489; Ponta et al. (1985) *Proc. Nat'l Acad. Sci. USA.* 82:1020; Sakai et al. (1988) *Genes and Dev.* 2:1144); β-interferon/poly(rI)X and poly(rc) (Tavernier et al. (1983) *Nature* 301:634); adenovirus 5 E2/E1A (Imperiale and Nevins (1984) *Mol. Cell. Biol.* 4:875); c-jun/phorbol ester (TPA), $H_2O_2$; collagenase/phorbol ester (TPA) (Angel et al. (1987) *Mol. Cell. Biol.* 7:2256); stromelysin/phorbol ester (TPA), IL-1 (Angel et al. (1987) *Cell* 49:729); SV40/phorbol ester (TPA) (Angel et al. (1987) *Cell* 49:729); murine MX gene/interferon, Newcastle disease virus; GRP78 gene/A23187 (Resendez Jr. et al. (1988) *Mol. Cell. Biol.* 8:4579); α-2-macroglobulin/IL-6; vimentin/serum (Kunz et al. (1989) *Nucl. Acids Res.* 17:1121); MHC class I gene H-2 kB/interferon (Blanar et al. (1989) *EMBO J.* 8:1139); HSP70/ela, SV40 large T antigen (Taylor and Kingston (1990) *Mol. Cell. Biol.* 10:165; Taylor and Kingston (1990) *Mol. Cell. Biol.* 10:176; Taylor et al. (1989) *J. Biol. Chem.* 264:15160); proliferin/phorbol ester-TPA (Mordacq and Linzer (1989) *Genes and Dev.* 3:760); tumor necrosis factor/PMA (Hensel et al. (1989) *Lymphokine Res.* 8:347); thyroid stimulating hormone α gene/thyroid hormone (Chatterjee et al. (1989) *Proc. Nat'l Acad. Sci. USA.* 86:9114); and, insulin E box/glucose.

A variety of translation control elements are known to those of ordinary skill in the art and can be used in the presently disclosed methods and compositions. These include, but are not limited to, ribosome binding sites, translation initiation and termination codons, and elements derived from picornaviruses (particularly an internal ribosome entry site, or IRES, also referred to as a CITE sequence).

In general, expression vectors of utility in recombinant DNA techniques are often in the form of plasmids (vectors). However, the invention is intended to include such other forms of expression vectors, such as viral vectors (e.g., replication defective retroviruses, adenoviruses, lentiviruses, and adeno-associated viruses). See, for example, U.S. Publication 2005214851, herein incorporated by reference. Retroviral vectors, particularly lentiviral vectors, are transduced by packaging the vectors into virions prior to contact with a cell.

An expression cassette can further comprise a selection marker. As used herein, the term "selection marker" comprises any polynucleotide, which when expressed in a cell allows for the selection of the transformed cell with the vector. For example, a selection marker can confer resistance to a drug, a nutritional requirement, or a cytotoxic drug. A selection marker can also induce a selectable phenotype such as fluorescence or a color deposit. A "positive selection marker" allows a cell expressing the marker to survive against a selective agent and thus confers a positive selection characteristic onto the cell expressing that marker. Positive selection marker/agents include, for example, neo/G418, neo/kanamycin, hyg/hygromycin, hisD/histidinol, gpt/xanthine, ble/bleomycin, HPRT/hypoxanthine. Other positive selection markers include DNA sequences encoding membrane-bound polypeptides. Such polypeptides are well known to those skilled in the art and can comprise, for example, a secretory sequence, an extracellular domain, a transmembrane domain and an intracellular domain. When expressed as a positive selection marker, such polypeptides associate with the cell membrane. Fluorescently labeled antibodies specific for the extracellular domain may then be used in a fluorescence activated cell sorter (FACS) to select for cells expressing the membrane-bound polypeptide. In some of the embodiments wherein the expression cassette further comprises a selectable marker, an internal ribosome entry site, or IRES, also referred to as a CITE sequence can be used to separate the coding sequences of the selectable marker and the polypolypeptide of interest, which allows for simultaneous transcription of the two sequences under the control of the same promoter sequences, but separate translation of the transcripts into polypeptides.

The host cells of the invention can also be used to produce nonhuman transgenic animals. For example, in one embodiment, a host cell of the invention is a fertilized oocyte or an embryonic stem cell into which a sequence encoding an ALK resistance mutant polypeptide has been introduced. Such host cells can then be used to create nonhuman transgenic animals in which an exogenous sequence encoding an ALK resistance mutant polypeptide has been introduced into their genome or homologous recombinant animals. In some embodiments, the ALK resistance mutant is part of an ALK oncogenic fusion protein. Such animals are useful for screening candidate agents that inhibit the ALK resistance mutants using assays described elsewhere herein to identify agents that are capable of inhibiting the presently disclosed ALK resistance mutants or to further validate the ability of novel inhibitors to inhibit the growth of cancer associated with aberrant ALK activity that is resistant to at least one ALK kinase inhibitor.

As used herein, a "transgenic animal" is a nonhuman animal, in specific embodiments a mammal, a rodent such as a rat or mouse, in which one or more of the cells of the animal includes a transgene. Other examples of transgenic animals include nonhuman primates, sheep, dogs, cows, goats, chickens, amphibians, etc. A transgene is exogenous DNA that is integrated into the genome of a cell from which a transgenic animal develops and which remains in the genome of the mature animal, thereby directing the expression of an encoded gene product in one or more cell types or tissues of the transgenic animal. As used herein, a "homologous recombinant animal" is a nonhuman animal, in specific embodiments a mammal, in other embodiments a mouse, in which an endogenous ALK gene has been altered by homologous recombination between the endogenous gene and an exogenous DNA molecule introduced into a cell of the animal, e.g., an embryonic cell of the animal, prior to development of the animal.

A transgenic animal of the invention can be created by introducing an ALK resistance mutant polypeptide encoding nucleic acid into the male pronuclei of a fertilized oocyte, e.g., by microinjection, retroviral infection, and allowing the oocyte to develop in a pseudopregnant female foster animal. Such sequences can be introduced as a transgene into the genome of a nonhuman animal. Intronic sequences and polyadenylation signals can also be included in the transgene to increase the efficiency of expression of the transgene. A tissue-specific regulatory sequence(s) can be operably linked to the transgene to direct expression of the sequence particular cells. Methods for generating transgenic animals via embryo manipulation and microinjection, particularly animals such as mice, have become conventional in the art and are described, for example, in U.S. Pat. Nos. 4,736,866, 4,870, 009, and 4,873,191 and in Hogan (1986) *Manipulating the Mouse Embryo* (Cold Spring Harbor Laboratory Press, Cold Spring Harbor, N.Y., 1986). Similar methods are used for production of other transgenic animals. A transgenic founder animal can be identified based upon the presence of the ALK resistance mutant protein or the polynucleotide comprising an ALK resistance mutation in its genome and/or expression of mRNA of such sequences in tissues or cells of the animals. A transgenic founder animal can then be used to breed additional animals carrying the transgene. Moreover, transgenic animals carrying a transgene can further be bred to other transgenic animals carrying other transgenes.

To create a homologous recombinant animal, one prepares a vector containing at least a portion of a sequence encoding an ALK resistance mutant polypeptide to thereby allow for the expression of an ALK resistance mutant polypeptide. In one embodiment, the homologous recombination vector, the altered portion of the ALK gene is flanked at its 5' and 3' ends by additional nucleic acids of the ALK gene to allow for homologous recombination to occur between the exogenous ALK gene carried by the vector and an endogenous ALK gene in an embryonic stem cell. The additional flanking ALK nucleic acid is of sufficient length for successful homologous recombination with the endogenous gene. Typically, several kilobases of flanking DNA (at both the 5' and 3' ends) are included in the vector (see, e.g., Thomas and Capecchi (1987) *Cell* 51:503 for a description of homologous recombination vectors). The vector is introduced into an embryonic stem cell line (e.g., by electroporation), and cells in which the introduced ALK gene has homologously recombined with the endogenous ALK gene are selected (see, e.g., Li et al. (1992) *Cell* 69:915). The selected cells are then injected into a blastocyst of an animal (e.g., a mouse) to form aggregation chimeras (see, e.g., Bradley (1987) in *Teratocarcinomas and Embryonic Stem Cells: A Practical Approach*, ed. Robertson (IRL, Oxford pp. 113-152). A chimeric embryo can then be implanted into a suitable pseudopregnant female foster animal and the embryo brought to term. Progeny harboring the homologously recombined DNA in their germ cells can be used to breed animals in which all cells of the animal contain the homologously recombined DNA by germline transmission of the transgene. Methods for constructing homologous recombination vectors and homologous recombinant animals are described further in Bradley (1991) *Current Opinion in Bio/Technology* 2:823-829 and in PCT Publication Nos. WO 90/11354, WO 91/01140, WO 92/0968, and WO 93/04169.

In another embodiment, transgenic nonhuman animals containing selected systems that allow for regulated expression of the transgene can be produced. One example of such a system is the cre/loxP recombinase system of bacteriophage P1. For a description of the cre/loxP recombinase system, see, e.g., Lakso et al. (1992) *Proc. Natl. Acad. Sci. USA* 89:6232-6236. Another example of a recombinase system is the FLP recombinase system of *Saccharomyces cerevisiae* (O'Gorman et al. (1991) *Science* 251:1351-1355). If a cre/loxP recombinase system is used to regulate expression of the transgene, animals containing transgenes encoding both the Cre recombinase and a selected protein are required. Such animals can be provided through the construction of "double" transgenic animals, e.g., by mating two transgenic animals, one containing a transgene encoding a selected protein and the other containing a transgene encoding a recombinase.

Clones of the nonhuman transgenic animals described herein can also be produced according to the methods described in Wilmut et al. (1997) *Nature* 385:810-813 and PCT Publication Nos. WO 97/07668 and WO 97/07669.

As noted herein, the invention includes antibodies that specifically bind to the ALK resistance mutant polypeptides. As discussed herein, these antibodies are referred to as "anti-ALK resistance mutant antibodies". Thus, by "anti-ALK resistance mutant antibodies" is intended antibodies specific for the ALK polypeptides disclosed herein that are resistant to at least one ALK kinase inhibitor. The term also encompasses antibodies that are specific for ALK oncogenic fusion proteins comprising an ALK polypeptide having an ALK inhibitor resistance mutation. The respective antibodies can be used alone or in combination in the methods of the invention.

Antibodies, including monoclonal antibodies (mAbs), can be made by standard protocols. See, for example, Harlow and Lane, *Using Antibodies: A Laboratory Manual*, CSHL, New York, 1999. Briefly, a mammal such as a mouse, hamster or rabbit can be immunized with an immunogenic form of a peptide or a peptide complex. Techniques for conferring immunogenicity on a protein or peptide include conjugation to carriers or other techniques, well known in the art.

By "antibodies that specifically bind" is intended that the antibodies will not substantially cross react with another polypeptide. By "not substantially cross react" is intended that the antibody or fragment has a binding affinity for a different polypeptide which is less than 10%, less than 5%, or less than 1%, of the binding affinity for the particular ALK resistance mutant polypeptide.

In specific embodiments, the anti-ALK resistance mutant antibody binds specifically to a particular ALK resistance mutant polypeptide and reduces the kinase activity of the kinase. Thus, in specific embodiments, the anti-ALK resistance mutant antibody is an ALK resistance mutant inhibitor.

The anti-ALK resistance mutant antibodies disclosed herein and for use in the methods of the present invention can be produced using any antibody production method known to those of skill in the art. Thus, polyclonal sera may be prepared by conventional methods. In general, a solution containing the ALK resistance mutant polypeptide or a fragment thereof is first used to immunize a suitable animal, preferably a mouse, rat, rabbit, or goat. Rabbits or goats are preferred for the preparation of polyclonal sera due to the volume of serum obtainable, and the availability of labeled anti-rabbit and anti-goat antibodies.

Polyclonal sera can be prepared in a transgenic animal, preferably a mouse bearing human immunoglobulin loci. In a preferred embodiment, Sf9 (*Spodoptera frugiperda*) cells expressing the ALK resistance mutant polypeptide or fragment thereof are used as the immunogen. Immunization can also be performed by mixing or emulsifying the antigen-containing solution in saline, preferably in an adjuvant such as Freund's complete adjuvant, and injecting the mixture or emulsion parenterally (generally subcutaneously or intramuscularly). A dose of 50-200 µg/injection is typically sufficient. Immunization is generally boosted 2-6 weeks later with one or more injections of the protein in saline, preferably using Freund's incomplete adjuvant. One may alternatively generate antibodies by in vitro immunization using methods known in the art, which for the purposes of this invention is considered equivalent to in vivo immunization. Polyclonal antisera are obtained by bleeding the immunized animal into a glass or plastic container, incubating the blood at 25° C. for one hour, followed by incubating at 4° C. for 2-18 hours. The serum is recovered by centrifugation (e.g., 1,000×g for 10 minutes). About 20-50 ml per bleed may be obtained from rabbits.

Production of the Sf9 cells is disclosed in U.S. Pat. No. 6,004,552. Briefly, a sequence encoding the ALK resistance mutant polypeptide is recombined into a baculovirus using transfer vectors. The plasmid is co-transfected with wild-type baculovirus DNA into Sf9 cells. Recombinant baculovirus-infected Sf9 cells are identified and clonally purified.

In some embodiments, the antibody is monoclonal in nature. By "monoclonal antibody" is intended an antibody obtained from a population of substantially homogeneous antibodies, that is, the individual antibodies comprising the population are identical except for possible naturally occurring mutations that may be present in minor amounts. The term is not limited regarding the species or source of the antibody. The term encompasses whole immunoglobulins as well as fragments such as Fab, F(ab')2, Fv, and others which retain the antigen binding function of the antibody. Monoclonal antibodies are highly specific, being directed against a single antigenic site on the target polypeptide. Furthermore, in contrast to conventional (polyclonal) antibody preparations that typically include different antibodies directed against different determinants (epitopes), each monoclonal antibody is directed against a single determinant on the antigen. The modifier "monoclonal" indicates the character of the antibody as being obtained from a substantially homogeneous population of antibodies, and is not to be construed as requiring production of the antibody by any particular method. For example, the monoclonal antibodies to be used in accordance with the present invention may be made by the hybridoma method first described by Kohler and Milstein (*Nature* 256:495-97, 1975), or may be made by recombinant DNA methods (see, e.g., U.S. Pat. No. 4,816,567). The "monoclonal antibodies" may also be isolated from phage antibody libraries using the techniques described in, for example, Clackson et al. (*Nature* 352:624-28, 1991), Marks et al. (*J. Mol. Biol.* 222:581-97, 1991) and U.S. Pat. No. 5,514,548.

By "epitope" is intended the part of an antigenic molecule to which an antibody is produced and to which the antibody will bind. Epitopes can comprise linear amino acid residues (i.e., residues within the epitope are arranged sequentially one after another in a linear fashion), nonlinear amino acid residues (referred to herein as "nonlinear epitopes"—these epitopes are not arranged sequentially), or both linear and nonlinear amino acid residues. For purposes of the presently disclosed subject matter, the epitope that is recognized by the specific anti-ALK resistance mutant antibodies is one that is found in the particular ALK resistance mutant and is not present in the native ALK polypeptide.

As discussed herein, mAbs can be prepared using the method of Kohler and Milstein, or a modification thereof. Typically, a mouse is immunized with a solution containing an antigen. Immunization can be performed by mixing or emulsifying the antigen-containing solution in saline, preferably in an adjuvant such as Freund's complete adjuvant, and injecting the mixture or emulsion parenterally. Any method of immunization known in the art may be used to obtain the monoclonal antibodies of the invention. After immunization of the animal, the spleen (and optionally, several large lymph nodes) are removed and dissociated into single cells. The spleen cells may be screened by applying a cell suspension to a plate or well coated with the antigen of interest. The B cells expressing membrane bound immunoglobulin specific for the antigen bind to the plate and are not rinsed away. Resulting B cells, or all dissociated spleen cells, are then induced to fuse with myeloma cells to form hybridomas, and are cultured in a selective medium. The resulting cells are plated by serial dilution and are assayed for the production of antibodies that specifically bind the antigen of interest (and that do not bind to unrelated antigens). The selected mAb-secreting hybridomas are then cultured either in vitro (e.g., in tissue culture bottles or hollow fiber reactors), or in vivo (as ascites in mice).

Where the anti-ALK resistance mutant antibodies of the invention are to be prepared using recombinant DNA methods, the DNA encoding the monoclonal antibodies is readily isolated and sequenced using conventional procedures (e.g., by using oligonucleotide probes that are capable of binding specifically to genes encoding the heavy and light chains of murine antibodies). The hybridoma cells described herein can serve as a source of such DNA. Once isolated, the DNA can be placed into expression vectors, which are then transfected into host cells such as *E. coli* cells, simian COS cells, Chinese Hamster Ovary (CHO) cells, or myeloma cells that do not otherwise produce immunoglobulin protein, to obtain the synthesis of monoclonal antibodies in the recombinant host cells. Review articles on recombinant expression in bacteria of DNA encoding an antibody include Skerra (1993) *Curr. Opinion in Immunol.* 5:256-62; and Phickthun (1992) *Immunol. Revs.* 130:151-88. Alternatively, the antibody can be produced in a cell line such as a CHO cell line, as disclosed in U.S. Pat. Nos. 5,545,403; 5,545,405 and 5,998,144. Briefly the cell line is transfected with vectors capable of expressing a light chain and a heavy chain, respectively. By transfecting the two proteins on separate vectors, chimeric antibodies can be produced. Another advantage is the correct glycosylation of the antibody.

Additionally, the term "anti-ALK resistance mutant antibody" as used herein encompasses chimeric and humanized anti-ALK resistance mutant antibodies. By "chimeric" antibodies is intended antibodies that are most preferably derived using recombinant deoxyribonucleic acid techniques and which comprise both human (including immunologically "related" species, e.g., chimpanzee) and non-human components. Thus, the constant region of the chimeric antibody is most preferably substantially identical to the constant region of a natural human antibody; the variable region of the chimeric antibody is most preferably derived from a non-human source and has the desired antigenic specificity to the ALK resistance mutant antigen. The non-human source can be any vertebrate source that can be used to generate antibodies to a human ALK resistance mutant antigen or material comprising a human ALK resistance mutant antigen. Such non-human sources include, but are not limited to, rodents (e.g., rabbit, rat, mouse, etc.; see, e.g., U.S. Pat. No. 4,816,567) and non-human primates (e.g., Old World Monkeys, Apes, etc.; see, e.g., U.S. Pat. Nos. 5,750,105 and 5,756,096). As used herein, the phrase "immunologically active" when used in reference to chimeric/humanized anti-ALK resistance mutant antibodies means chimeric/humanized antibodies that bind a particular ALK resistance mutant.

By "humanized" is intended forms of anti-ALK resistance mutant antibodies that contain minimal sequence derived from non-human immunoglobulin sequences. For the most part, humanized antibodies are human immunoglobulins (recipient antibody) in which residues from a hypervariable region (also known as complementarity determining region or CDR) of the recipient are replaced by residues from a hypervariable region of a non-human species (donor antibody) such as mouse, rat, rabbit, or nonhuman primate having the desired specificity, affinity, and capacity. The phrase "complementarity determining region" refers to amino acid sequences which together define the binding affinity and specificity of the natural Fv region of a native immunoglobulin binding site. See, for example, Chothia et al. (1987) *J. Mol. Biol.* 196:901-17; and Kabat et al. (U.S. Dept. of Health and Human Services, NIH Publication No. 91-3242, 1991). The phrase "constant region" refers to the portion of the antibody molecule that confers effector functions.

Humanization can be essentially performed following the methods described by Jones et al. (1986) *Nature* 321:522-25; Riechmann et al. (1988) *Nature* 332:323-27; and Verhoeyen et al. (1988) *Science* 239:1534-36, by substituting rodent or mutant rodent CDRs or CDR sequences for the corresponding sequences of a human antibody. See also U.S. Pat. Nos. 5,225,539; 5,585,089; 5,693,761; 5,693,762; and 5,859,205. In some instances, residues within the framework regions of one or more variable regions of the human immunoglobulin are replaced by corresponding non-human residues (see, for example, U.S. Pat. Nos. 5,585,089; 5,693,761; 5,693,762; and 6,180,370). Furthermore, humanized antibodies may comprise residues that are not found in the recipient antibody or in the donor antibody. These modifications are made to further refine antibody performance (e.g., to obtain desired affinity). In general, the humanized antibody will comprise substantially all of at least one, and typically two, variable domains, in which all or substantially all of the hypervariable regions correspond to those of a non-human immunoglobulin and all or substantially all of the framework regions are those of a human immunoglobulin sequence. The humanized antibody optionally also will comprise at least a portion of an immunoglobulin constant region (Fc), typically that of a human immunoglobulin. Accordingly, such "humanized" antibodies may include antibodies wherein substantially less than an intact human variable domain has been substituted by the corresponding sequence from a non-human species.

Also encompassed by the term "anti-ALK resistance mutant antibodies" are xenogeneic or modified anti-ALK resistance mutant antibodies produced in a non-human mammalian host, more particularly a transgenic mouse, characterized by inactivated endogenous immunoglobulin loci. In such transgenic animals, competent endogenous genes for the expression of light and heavy subunits of host immunoglobulins are rendered non-functional and substituted with the analogous human immunoglobulin loci. These transgenic animals produce human antibodies in the substantial absence of light or heavy host immunoglobulin subunits. See, for example, U.S. Pat. Nos. 5,877,397 and 5,939,598. Preferably, fully human antibodies to a particular ALK resistance mutant can be obtained by immunizing transgenic mice. One such mouse is disclosed in U.S. Pat. Nos. 6,075,181; 6,091,001; and 6,114,598.

Fragments of the anti-ALK resistance mutant antibodies are suitable for use in the methods of the invention so long as they retain the desired affinity of the full-length antibody. Thus, a fragment of an anti-ALK resistance mutant antibody will retain the ability to specifically bind to a particular ALK resistance mutant polypeptide. Such fragments are characterized by properties similar to the corresponding full-length anti-ALK resistance mutant antibody; that is, the fragments will specifically bind a particular ALK resistance mutant polypeptide. Such fragments are referred to herein as "antigen-binding" fragments.

Suitable antigen-binding fragments of an antibody comprise a portion of a full-length antibody, generally the antigen-binding or variable region thereof. Examples of antibody fragments include, but are not limited to, Fab, F(ab')$_2$, and Fv fragments and single-chain antibody molecules. By "Fab" is intended a monovalent antigen-binding fragment of an immunoglobulin that is composed of the light chain and part of the heavy chain. By F(ab')$_2$ is intended a bivalent antigen-binding fragment of an immunoglobulin that contains both light chains and part of both heavy chains. By "single-chain Fv" or "sFv" antibody fragments is intended fragments comprising the $V_H$ and $V_L$ domains of an antibody, wherein these domains are present in a single polypeptide chain. See, for example, U.S. Pat. Nos. 4,946,778; 5,260,203; 5,455,030; and 5,856,456. Generally, the Fv polypeptide further comprises a polypeptide linker between the $V_H$ and $V_L$ domains that enables the sFv to form the desired structure for antigen binding. For a review of sFv see Pluckthun (1994) in *The Pharmacology of Monoclonal Antibodies*, Vol. 113, ed. Rosenburg and Moore (Springer-Verlag, New York), pp. 269-315.

Antibodies or antibody fragments can be isolated from antibody phage libraries generated using the techniques described in, for example, McCafferty et al. (1990) *Nature* 348:552-54; and U.S. Pat. No. 5,514,548. Clackson et al. (1991) *Nature* 352:624-28; and Marks et al. (1991) *J. Mol. Biol.* 222:581-97 describe the isolation of murine and human antibodies, respectively, using phage libraries. Subsequent publications describe the production of high affinity (nM range) human antibodies by chain shuffling (Marks et al. (1992) *Bio/Technology* 10:779-83), as well as combinatorial infection and in vivo recombination as a strategy for constructing very large phage libraries (Waterhouse et al. (1993) *Nucleic. Acids Res.* 21:2265-66). Thus, these techniques are viable alternatives to traditional monoclonal antibody hybridoma techniques for isolation of monoclonal antibodies.

Various techniques have been developed for the production of antibody fragments. Traditionally, these fragments were derived via proteolytic digestion of intact antibodies (see, e.g., Morimoto et al. (1992) *J. Biochem. Biophys. Methods* 24:107-17; and Brennan et al. (1985) *Science* 229:81-3). However, these fragments can now be produced directly by recombinant host cells. For example, the antibody fragments can be isolated from the antibody phage libraries discussed above. Alternatively, Fab fragments can be directly recovered from *E. coli* and chemically coupled to form F(ab')$_2$ fragments (Carter et al. (1992) *Bio/Technology* 10:163-67). According to another approach, F(ab')$_2$ fragments can be isolated directly from recombinant host cell culture. Other techniques for the production of antibody fragments will be apparent to the skilled practitioner.

The invention provides a method (also referred to herein as a "screening assay") for identifying specific binding agents and/or inhibitors of a particular presently disclosed ALK resistance mutant. As discussed herein, identification of various ALK resistance mutant polypeptide binding agents are of interest, including ALK resistance mutant specific binding agents and ALK resistance mutant inhibitors.

Screening methods for ALK resistance mutant binding agents or ALK resistance mutant inhibitors involve determining if a test compound can bind, specifically or non-specifically, to an ALK resistance mutant and/or determining if the test compound can reduce the kinase activity of the particular ALK resistance mutant.

The candidate agents employed in the various screening assays can include any compound including, for example, peptides, peptidomimetics, polynucleotides, small molecules, antibodies, or other drugs. In certain embodiments, the candidate agents are small molecules. Such candidate agents can be obtained using any of the numerous approaches in combinatorial library methods known in the art, including biological libraries, spatially addressable parallel solid phase or solution phase libraries, synthetic library methods requiring deconvolution, the "one-bead one-compound" library method, and synthetic library methods using affinity chromatography selection. The biological library approach is limited to peptide libraries, while the other four approaches are applicable to peptide, nonpeptide oligomer, or small molecule libraries of compounds (Lam (1997) *Anticancer Drug Des.* 12:145).

Examples of methods for the synthesis of molecular libraries can be found in the art, for example in: DeWitt et al. (1993) *Proc. Natl. Acad. Sci. USA* 90:6909; Erb et al. (1994) *Proc. Natl. Acad. Sci. USA* 91:11422; Zuckermann et al. (1994). *J. Med. Chem.* 37:2678; Cho et al. (1993) *Science* 261:1303; Carrell et al. (1994) *Angew. Chem. Int. Ed. Engl.* 33:2059; Carell et al. (1994) *Angew. Chem. Int. Ed. Engl.* 33:2061; and Gallop et al. (1994) *J. Med. Chem.* 37:1233.

Known pharmacological agents and even known ALK inhibitors may be subjected to directed or random chemical modifications, such as acylation, alkylation, esterification, amidification to produce structural analogs that can be tested for the ability to inhibit the kinase activity of at least one of the ALK resistance mutants. Alternatively, candidate agents can be derived from any organism, including bacteria, fungi, plants, or animals.

Libraries of compounds may be presented in solution (e.g., Houghten (1992) *Bio/Techniques* 13:412-421), or on beads (Lam (1991) *Nature* 354:82-84), chips (Fodor (1993) *Nature* 364:555-556), bacteria (U.S. Pat. No. 5,223,409), spores (U.S. Pat. Nos. 5,571,698; 5,403,484; and 5,223,409), plasmids (Cull et al. (1992) *Proc. Natl. Acad. Sci. USA* 89:1865-1869), or phage (Scott and Smith (1990) *Science* 249:386-390; Devlin (1990) *Science* 249:404-406; Cwirla et al. (1990) *Proc. Natl. Acad. Sci. USA* 87:6378-6382; and Felici (1991) *J. Mol. Biol.* 222:301-310).

Determining the ability of the candidate agent to bind to the particular ALK resistance mutant can be accomplished, for example, by coupling the candidate agent with a radioisotope or enzymatic label such that binding of the candidate agent to the ALK resistance mutant polypeptide can be determined by detecting the labeled agent in a complex. For example, candidate agents can be labeled with $^{125}$I, $^{35}$S, $^{14}$C, or $^3$H, either directly or indirectly, and the radioisotope detected by direct counting of radioemission or by scintillation counting. Alternatively, candidate agents can be enzymatically labeled with, for example, horseradish peroxidase, alkaline phosphatase, or luciferase, and the enzymatic label detected by determination of conversion of an appropriate substrate to product.

In one embodiment, an assay to identify specific binding agents for an ALK resistance mutant is a cell-free assay comprising contacting an ALK resistance mutant polypeptide with a candidate agent and determining the ability of the candidate agent to bind to the ALK resistance mutant polypeptide. Binding of the candidate agent to the ALK resistance mutant polypeptide can be determined either directly or indirectly. An indirect assay could include assaying for a reduction in ALK kinase activity (e.g., phosphorylation of ALK substrates).

In some assays, it may be desirable to immobilize either the ALK resistance mutant or the candidate agent to facilitate automation of the assay. In one embodiment, the ALK resistance mutant can be immunoprecipitated from a cellular lysate, wherein the complex is bound to a matrix (e.g., beads). In another embodiment, a fusion protein can be provided that adds a domain to the candidate agent or the ALK resistance mutant polypeptide that allows the candidate agent or the ALK resistance mutant to be bound to a matrix. For example, ALK resistance mutant polypeptides comprising a glutathione-S-transferase/ALK resistance mutant fusion protein can be adsorbed onto glutathione sepharose beads (Sigma Chemical, St. Louis, Mo.) or glutathione-derivatized microtitre plates, which are then combined with the candidate agent, and the mixture incubated under conditions conducive to complex formation between the candidate agent and the ALK resistance mutant (e.g., at physiological conditions for salt and pH). Following incubation, the beads or microtitre plate wells are washed to remove any unbound components and complex formation of the candidate agent and ALK resistance mutant polypeptide is measured either directly or indirectly, for example, as described above.

Other techniques for immobilizing proteins on matrices can also be used in the screening assays of the invention. For example, either the ALK resistance mutant polypeptide or the candidate agent can be immobilized utilizing conjugation of biotin and streptavidin. Biotinylated ALK resistance mutants or candidate agents can be prepared from biotin-NHS(N-hydroxy-succinimide) using techniques well known in the art (e.g., biotinylation kit, Pierce Chemicals, Rockford, Ill.), and immobilized in the wells of streptavidin-coated plates (Pierce Chemicals).

In yet another aspect of the invention, the ALK resistance mutant polypeptides can be used as "bait proteins" in a two-hybrid assay or three-hybrid assay (see, e.g., U.S. Pat. No. 5,283,317; Zervos et al. (1993) *Cell* 72:223-232; Madura et al. (1993) *J. Biol. Chem.* 268:12046-12054; Bartel et al. (1993) *Bio/Techniques* 14:920-924; Iwabuchi et al. (1993) *Oncogene* 8:1693-1696; and PCT Publication No. WO 94/10300), to identify other proteins, which bind to or interact with the ALK resistance mutant polypeptide and, in some embodiments, inhibit ALK resistance mutant kinase activity.

In embodiments wherein candidate agents that specifically bind ALK inhibitor resistance mutants are desired, the ALK inhibitor resistance mutant may be in either an active or inactive state when contacted with the candidate agent. An active state is one wherein the three tyrosine residues (tyrosines 1278, 1282, and 1283 of full-length ALK) within the activation domain are phosphorylated. Conversely, an inactive state is one wherein the activation domain tyrosine residues are not phosphorylated and the activation domain is in its closed conformation.

In those embodiments wherein an ALK resistance mutant inhibitor is desired, the assay comprises contacting the ALK resistance mutant polypeptide with a candidate agent and determining the ability of the candidate agent to reduce or completely inhibit the kinase activity of the ALK resistance mutant. Determining the ability of the candidate agent to inhibit the activity of an ALK resistance mutant can be accomplished, for example, by determining the ability of the ALK resistance mutant to phosphorylate ALK substrates or to autophosphorylate in the presence of the test compound. Methods for assaying the kinase activity of an ALK resistance mutant are discussed elsewhere herein, and include in vitro kinase assays wherein ALK polypeptides are isolated via affinity purification or immunoprecipitation and the autophosphorylation of ALK or the phosphorylation of a substrate protein or peptide is measured in the presence of ATP.

Similar to screening assays for specific binders, the ALK resistance mutant can be in an active or inactivate state when contacted with the candidate agent in screens for inhibitors of the resistance mutant. Inhibitors that bind to ALK in the inactive state are particularly desirable because the structure of the kinase domain of receptor tyrosine kinases when inactive is generally more unique than the conformation of the activated kinase. In those embodiments wherein the ALK resistance mutant is contacted with the candidate agent in the inactive state, the kinase is activated prior to testing the effect of the candidate agent on the kinase activity. ALK inhibitor resistance mutants can be activated through the addition of a ligand (e.g., pleiotropin, midkine) in those instances wherein the ALK mutant polypeptide comprises the ligand binding domain. Alternatively, the ALK resistance mutant polypeptide can comprise the cytoplasmic domain (e.g., amino acids 1058-1620) of the kinase comprising the kinase domain along with domains necessary for interacting with downstream effectors, fused to an inducible dimerization or oligomerization domain. An inducible dimerization domain or inducible oligomerization domain is a polypeptide sequence that can be stimulated to dimerize or oligomerize in the presence of a dimerized or oligomerized ligand. A non-limiting example of an inducible dimerization domain is one comprising at least one FKBP12 polypeptide that can be dimerized through the addition of the cell-permeable synthetic dimerized ligand FK1012 (Spencer et al. (1993) Science 262:989, which is herein incorporated by reference in its entirety). Upon dimerization or oligomerization, the ALK resistance mutant-inducible dimerization/oligomerization domain fusion protein becomes activated.

Cell-based assays can also be used to measure ALK kinase activity wherein ALK autophosphorylation or phosphorylation of an ALK substrate is determined using immunoblotting or an enzyme-linked immunoassay, for example. The inhibition of ALK kinase activity can also be assessed indirectly with cell-based assays. In such embodiments, the ALK resistance mutant is expressed in a eukaryotic cell (either endogenously or exogenously wherein the sequence is introduced via transformation, for example). If the full-length ALK resistance mutant polypeptide is used for such experiments, an activating ligand (e.g., pleiotrophin, midkine) is added to the culture. In other embodiments, the ALK resistance mutant is a constitutively active ALK resistance mutant-oncogenic fusion protein. In yet other embodiments, the ALK resistance mutant polypeptide comprises the cytoplasmic domain (e.g., amino acids 1058-1620) fused to an inducible dimerization or oligomerization domain and the fusion protein is activated through the addition of a cell-permeable dimerized or oligomerized ligand (Spencer et al. (1993) Science 262:989). Activation of ALK leads to the stimulation of cell proliferation, cell survival, promotion of anchorage-independent growth, and cellular migration and invasion. Therefore, candidate agents that inhibit the kinase activity of an ALK resistance mutant can be selected based on the ability of the candidate agent to inhibit cell growth, stimulate cell death, inhibit anchorage-independent growth, and/or inhibit cell migration or invasion of cells expressing the activated ALK resistance mutant.

As used herein, "cell growth" refers to cell proliferation, cell division, or progression through the cell cycle. "Cell death" includes both apoptosis and necrosis. Such cell-based assays are known in the art (von Bubnoff et al. (2005) Blood 105:1652-1659; von Bubnoff et al. (2006) Blood 108:1328-1333; Kancha et al. (2009) Clin Cancer Res 15:460-467; von Bubnoff et al. (2009) Cancer Res 69:3032-3041; von Bubnoff et al. (2005) Cell Cycle 4:400-406; each of which is herein incorporated by reference in its entirety) and described elsewhere herein (see Example 1).

Any method known in the art can be used to measure the growth rate of a cell or an effect on cell survival, including, but not limited to, optical density ($OD_{600}$), $CO_2$ production, $O_2$ consumption, assays that measure mitochondrial function, such as those utilizing tetrazolium salts (e.g., MTT, XTT), or other colorimetric reagents (e.g., the WST-1 reagent available from Roche), assays that measure or estimate DNA content, including, but not limited to fluorometric assays such as those utilizing the fluorescent dye Hoechst 33258, assays that measure or estimate protein content, including, but not limited to, the sulforhodamine B (SRB) assay, manual or automated cell counts (with or without the Trypan Blue stain to distinguish live cells), and clonogenic assays with manual or automated colony counts. Non-limiting examples of assays that can be used to measure levels of apoptosis include, but are not limited to, measurement of DNA fragmentation, caspase activation assays, TUNEL staining, annexin V staining "Anchorage-independent growth" refers to, in contrast to adherent normal cells that must adhere to the extracellular matrix (anchorage) for their survival and growth, the general essential property of cancer cells capable of growing even without such an anchorage. Methods for measuring the anchorage dependence of cells are known in the art and include growing the cells in a soft agar medium or culturing cells under conditions in which spheroids (cell aggregates) can form. Such assays are described in U.S. Patent Application Publication Nos. 2008/0090776 and 2009/0099193.

"Cell migration" refers to the movement of cells, which in some embodiments can be towards a target (e.g., growth factors), which is also referred to as chemotaxis. "Cell invasion" refers to cellular movement through a matrix, such as the extracellular matrix. Methods are known in the art to measure cell migration and invasion, including transwell assays, wherein the movement of cells from one chamber to a second chamber is measured through quantitation of the number of cells in the second chamber. In variations of this assay, a chemoattractant is provided in the second chamber and/or the chambers are separated by a matrix comprising various components of the extracellular matrix (e.g., collagen).

Other assays that can be used to screen for an inhibitor of an ALK resistance mutant include the use of in vivo animal models (e.g., xenografts) for a cancer associated with aberrant ALK activity that express an ALK resistance mutant. The non-human animal model can be, for example, a mouse (e.g., nude mouse), rat, or hamster. Cancer cells endogenously expressing an ALK resistance mutant polypeptide or cells transformed by the expression of the ALK resistance mutant can be transplanted subcutaneously, intradermally, or intraperitoneally or into each organ. A non-human transgenic animal that has been genetically engineered to express an ALK resistance mutant-oncogenic fusion protein, such as those described elsewhere herein, can also be used. The ability of a candidate agent to inhibit ALK kinase activity can be confirmed by administering the candidate agent by a variety of administration methods, such as oral, intravenous, subcutaneous, and intraperitoneal administrations and measuring the volume or weight of the tumor of the animal model or progression of the disease. Such methods are known in the art and are described in U.S. Patent Application Publication Nos. 2008/0090776 and 2009/0099193.

In some embodiments, screening assays for agents that inhibit the kinase activity of an ALK resistance mutant include screening for agents that specifically reduce the expression of a presently disclosed ALK resistance mutant or ALK resistance mutant-oncogenic fusion protein. By "reduces" or "reducing" the expression level of a polynucleotide or a polypeptide encoded thereby is intended to mean, the polynucleotide or polypeptide level of the ALK resistance mutant is statistically lower than the polynucleotide level or polypeptide level of the same target sequence in an appropriate control which is not exposed to the silencing element. In particular embodiments, reducing the polynucleotide level and/or the polypeptide level of the target sequence according to the presently disclosed subject matter results in less than 95%, less than 90%, less than 80%, less than 70%, less than 60%, less than 50%, less than 40%, less than 30%, less than 20%, less than 10%, or less than 5% of the polynucleotide level, or the level of the polypeptide encoded thereby, of the same target sequence in an appropriate control. Methods to assay for the level of the RNA transcript, the level of the encoded polypeptide, or the activity of the polynucleotide or polypeptide are discussed elsewhere herein.

Thus, the present invention further provides methods and compositions to reduce the level of expression of an ALK resistance mutant by introducing into a cell expressing the ALK resistance mutant a silencing element that reduces or eliminates the level of expression of an ALK resistance mutant target polynucleotide or the polypeptide encoded thereby upon introduction or expression of the silencing element. Further, methods for screening candidate agents for those that specifically reduce ALK resistance mutant expression include introducing into a cell expressing the ALK resistance mutant the candidate agent (e.g., silencing element) and determining the level of expression of the ALK resistance mutant.

The expression of the ALK resistance mutant can be inhibited by any means known in the art, including the introduction of polypeptides that inhibit the expression of the ALK resistance mutant, the introduction of nucleotide sequences comprising silencing elements that encode polynucleotides useful for transposon insertion into the ALK mutant gene, homologous recombination/genetic knock-out of the ALK mutant gene, silencing elements that encode zinc finger proteins that bind to an ALK mutant gene and reduce its expression, silencing elements that encode antisense oligonucleotides or dsRNA molecules (e.g., shRNA, siRNA), or nucleotide sequences that encode antibodies or other polypeptides that inhibit Nrl expression or activity.

In one embodiment, the silencing element encodes a zinc finger protein that binds to an ALK resistance mutant gene, resulting in reduced expression of the gene. In particular embodiments, the zinc finger protein binds to a regulatory region of an ALK resistance mutant gene. In other embodiments, the zinc finger protein binds to a messenger RNA (i.e., transcript) encoding an ALK resistance mutant and prevents its translation. Methods of selecting sites for targeting by zinc finger proteins have been described, for example, in U.S. Pat. No. 6,453,242, which is herein incorporated by reference.

In some embodiments of the present invention, the expression of an ALK resistance mutant is reduced or eliminated by disrupting an ALK resistance mutant gene. The ALK resistance mutant gene may be disrupted by any method known in the art. For example, in one embodiment, the gene is disrupted by transposon tagging. In another embodiment, the gene is disrupted by mutagenizing cells using random or targeted mutagenesis, and selecting for cells that have reduced ALK activity.

In one embodiment of the invention, transposon tagging is used to reduce or eliminate the expression of an ALK resistance mutant. Transposon tagging comprises inserting a transposon within an endogenous ALK resistance mutant gene to reduce or eliminate expression of the ALK resistance mutant. In this embodiment, the expression of the ALK resistance mutant gene is reduced or eliminated by inserting a transposon within a regulatory region or coding region of the ALK resistance mutant gene. A transposon that is within an exon, intron, 5' or 3' untranslated sequence, a promoter, or any other regulatory sequence of an ALK resistance mutant gene may be used to reduce or eliminate the expression and/or activity of the encoded ALK resistance mutant. In these embodiments, the silencing element comprises or encodes a targeted transposon that can insert within an ALK resistance mutant gene.

In other embodiments, the silencing element comprises a nucleotide sequence useful for site-directed mutagenesis via homologous recombination with a region of an ALK resistance mutant gene. Insertional mutations in gene exons usually result in null-mutants. The invention encompasses additional methods for reducing or eliminating the activity or expression of ALK resistance mutants, such as those that involve promoter-based silencing. See, for example, Mette et al. (2000) *EMBO J.* 19: 5194-5201; Sijen et al. (2001) *Curr. Biol.* 11: 436-440; Jones et al. (2001) *Curr. Biol.* 11: 747-757.

As used herein, the term "silencing element" refers to a polynucleotide, which when expressed or introduced into a cell is capable of reducing or eliminating the level of expression of a target polynucleotide sequence or the polypeptide encoded thereby. The silencing element can comprise or encode an antisense oligonucleotide or an interfering RNA (RNAi). The term "interfering RNA" or "RNAi" refers to any RNA molecule which can enter an RNAi pathway and thereby reduce the expression of a target gene. The RNAi pathway features the Dicer nuclease enzyme and RNA-induced silencing complexes (RISC) that function to degrade or block the translation of a target mRNA. RNAi is distinct from antisense oligonucleotides that function through "antisense" mechanisms that typically involve inhibition of a target transcript by a single-stranded oligonucleotide through an RNase H-mediated pathway. See, Crooke (ed.) (2001) "*Antisense Drug Technology: Principles, Strategies, and Applications*" (1st ed), Marcel Dekker; ISBN: 0824705661; 1st edition.

As used herein, the term "gene" has its meaning as understood in the art. In general, a gene is taken to include gene regulatory sequences (e.g., promoters, enhancers, and the like) and/or intron sequences, in addition to coding sequences (open reading frames). It will further be appreciated that definitions of "gene" include references to nucleic acids that do not encode proteins but rather encode functional RNA molecules, or precursors thereof, such as microRNA or siRNA precursors, tRNAs, and the like.

As used herein, a "target gene" comprises any gene that one desires to decrease the level of expression. By "reduces" or "reducing" the expression level of a gene is intended to mean, the level of the encoded polynucleotide (i.e., target transcript) or the encoded polypeptide is statistically lower than the encoded polynucleotide level or encoded polypeptide level in an appropriate control which is not exposed to the silencing element. In particular embodiments, reducing the expression of an ALK resistance mutant gene results in less than 95%, less than 90%, less than 80%, less than 70%, less than 60%, less than 50%, less than 40%, less than 30%, less than 20%, less than 10%, or less than 5% of the level of the ALK resistance mutant transcript or the level of the ALK resistance mutant polypeptide in an appropriate control (e.g., the same cell prior to the introduction/expression of the silencing element or a similar cell at a similar stage in differentiation, same phenotype, same genotype. etc.). Methods to assay for the level of the RNA transcript, the level of the encoded polypeptide, or the activity of the polynucleotide or polypeptide are known in the art, and are described elsewhere herein.

The term "complementary" is used herein in accordance with its art-accepted meaning to refer to the capacity for precise pairing via hydrogen bonds (e.g., Watson-Crick base pairing or Hoogsteen base pairing) between two nucleosides, nucleotides or nucleic acids, and the like. For example, if a nucleotide at a certain position of a first nucleic acid is capable of stably hydrogen bonding with a nucleotide located opposite to that nucleotide in a second nucleic acid, when the nucleic acids are aligned in opposite 5' to 3' orientation (i.e., in anti-parallel orientation), then the nucleic acids are considered to be complementary at that position (where position may be defined relative to either end of either nucleic acid, generally with respect to a 5' end). The nucleotides located opposite one another can be referred to as a "base pair." A complementary base pair contains two complementary nucleotides, e.g., A and U, A and T, G and C, and the like, whereas a noncomplementary base pair contains two noncomplementary nucleotides (also referred to as a mismatch). Two polynucleotides are said to be complementary to each other when a sufficient number of corresponding positions in each molecule are occupied by nucleotides that hydrogen bond with each other, i.e., a sufficient number of base pairs are complementary.

The term "hybridize" as used herein refers to the interaction between two complementary nucleic acid sequences in which the two sequences remain associated with one another under appropriate conditions.

A silencing element can comprise the interfering RNA or antisense oligonucleotide, a precursor to the interfering RNA or antisense oligonucleotide, a template for the transcription of an interfering RNA or antisense oligonucleotide, or a template for the transcription of a precursor interfering RNA or antisense oligonucleotide, wherein the precursor is processed within the cell to produce an interfering RNA or antisense oligonucleotide. Thus, for example, a dsRNA silencing element includes a dsRNA molecule, a transcript or polyribonucleotide capable of forming a dsRNA, more than one transcript or polyribonucleotide capable of forming a dsRNA, a DNA encoding a dsRNA molecule, or a DNA encoding one strand of a dsRNA molecule. When the silencing element comprises a DNA molecule encoding an interfering RNA, it is recognized that the DNA can be transiently expressed in a cell or stably incorporated into the genome of the cell. Such methods are discussed in further detail elsewhere herein.

The silencing element can reduce or eliminate the expression level of a target gene by influencing the level of the target RNA transcript, by influencing translation of the target RNA transcript, or by influencing expression at the pre-transcriptional level (i.e., via the modulation of chromatin structure, methylation pattern, etc., to alter gene expression). See, for example, Verdel et al. (2004) *Science* 303:672-676; Pal-Bhadra et al. (2004) *Science* 303:669-672; Allshire (2002) *Science* 297:1818-1819; Volpe et al. (2002) *Science* 297:1833-1837; Jenuwein (2002) *Science* 297:2215-2218; and Hall et al. (2002) *Science* 297:2232-2237. Methods to assay for functional interfering RNA that are capable of reducing or eliminating the expression of a target gene are known in the art and disclosed elsewhere herein.

Any region of a transcript from the target gene (i.e., target transcript) can be used to design a domain of the silencing element that shares sufficient sequence identity to allow for the silencing element to decrease the level of the polynucleotide or polypeptide encoded by the target gene. For instance, the silencing element can be designed to share sequence identity to the 5' untranslated region of the target transcript, the 3' untranslated region of the target transcript, exonic regions of the target transcript, intronic regions of the target transcript, and any combination thereof.

The ability of a silencing element to reduce the level of the target transcript can be assessed directly by measuring the amount of the target transcript using, for example, Northern blots, nuclease protection assays, reverse transcription (RT)-PCR, real-time RT-PCR, microarray analysis, and the like. Alternatively, the ability of the silencing element to reduce the level of the polypeptide encoded by the target gene and target transcript can be measured directly using a variety of affinity-based approaches (e.g., using a ligand or antibody that specifically binds to the target polypeptide) including, but not limited to, Western blots, immunoassays, ELISA, flow cytometry, protein microarrays, and the like. In still other methods, the ability of the silencing element to reduce the level of the target polypeptide encoded by the target gene can be assessed indirectly, e.g., by measuring a functional activity of the polypeptide encoded by the transcript or by measuring a signal produced by the polypeptide encoded by the transcript.

Those of ordinary skill in the art will readily appreciate that a silencing element can be prepared according to any available technique including, but not limited to, chemical synthesis, enzymatic or chemical cleavage in vivo or in vitro, template transcription in vivo or in vitro, or combinations of the foregoing.

Various types of silencing elements are discussed in further detail below.

In one embodiment, the silencing element comprises or encodes a double stranded RNA molecule. As used herein, a "double stranded RNA" or "dsRNA" refers to a polyribonucleotide structure formed either by a single self-complementary RNA molecule or a polyribonucleotide structure formed by the expression of least two distinct RNA strands. Accordingly, as used herein, the term "dsRNA" is meant to encompass other terms used to describe nucleic acid molecules that are capable of mediating RNA interference or gene silencing, including, for example, small RNA (sRNA), short-interfering RNA (siRNA), double-stranded RNA (dsRNA), micro-RNA (miRNA), hairpin RNA, short hairpin RNA (shRNA), and others. See, for example, Meister and Tuschl (2004) *Nature* 431:343-349 and Bonetta et al. (2004) *Nature Methods* 1:79-86.

In specific embodiments, at least one strand of the duplex or double-stranded region of the dsRNA shares sufficient sequence identity or sequence complementarity to the target gene to allow for the dsRNA to reduce the level of expression of the target gene. As used herein, the strand that is complementary to the target transcript is the "antisense strand," and the strand homologous to the target transcript is the "sense strand."

In one embodiment, the dsRNA comprises a hairpin RNA. A hairpin RNA comprises an RNA molecule that is capable of folding back onto itself to form a double stranded structure. Multiple structures can be employed as hairpin elements. For example, the hairpin RNA molecule that hybridizes with itself to form a hairpin structure can comprise a single-stranded loop region and a base-paired stem. The base-paired stem region can comprise a sense sequence corresponding to all or part of the target transcript and further comprises an antisense sequence that is fully or partially complementary to the sense sequence. Thus, the base-paired stem region of the silencing element can determine the specificity of the silencing. See, for example, Chuang and Meyerowitz (2000) *Proc. Natl. Acad. Sci. USA* 97:4985-4990, herein incorporated by reference. A transient assay for the efficiency of hpRNA constructs to silence gene expression in vivo has been described by Panstruga et al. (2003) *Mol. Biol. Rep.* 30:135-140, herein incorporated by reference.

A "short interfering RNA" or "siRNA" comprises an RNA duplex (double-stranded region) and can further comprise one or two single-stranded overhangs, e.g., 3' or 5' overhangs. The duplex can be approximately 19 base pairs (bp) long, although lengths between 17 and 29 nucleotides, including 17, 18, 19, 20, 21, 22, 23, 24, 25, 26, 27, 28, and 29 nucleotides, can be used. An siRNA can be formed from two RNA molecules that hybridize together or can alternatively be generated from a single RNA molecule that includes a self-hybridizing portion. The duplex portion of an siRNA can include one or more bulges containing one or more unpaired and/or mismatched nucleotides in one or both strands of the duplex or can contain one or more noncomplementary nucleotide pairs. One strand of an siRNA (referred to herein as the antisense strand) includes a portion that hybridizes with a target transcript. In certain embodiments, one strand of the siRNA (the antisense strand) is precisely complementary with a region of the target transcript over at least about 17 nucleotides, 18 nucleotides, 19 nucleotides, 20 nucleotides, 21 nucleotides, or more meaning that the siRNA antisense strand hybridizes to the target transcript without a single mismatch (i.e., without a single noncomplementary base pair) over that length. In other embodiments, one or more mismatches between the siRNA antisense strand and the targeted portion of the target transcript can exist. In embodiments in which perfect complementarity is not achieved, any mismatches between the siRNA antisense strand and the target transcript can be located at or near the 3' end of the siRNA antisense strand. For example, in certain embodiments, nucleotides 1-9, 2-9, 2-10, and/or 1-10 of the antisense strand are perfectly complementary to the target.

Considerations for the design of effective siRNA molecules are discussed in McManus et al. (2002) Nature Reviews Genetics 3: 737-747 and in Dykxhoorn et al. (2003) Nature Reviews Molecular Cell Biology 4: 457-467. Such considerations include the base composition of the siRNA, the position of the portion of the target transcript that is complementary to the antisense strand of the siRNA relative to the 5' and 3' ends of the transcript, and the like. A variety of computer programs also are available to assist with selection of siRNA sequences, e.g., from Ambion, at the web site having the URL www.sinc.sunysb.edu/Stu/shilin/rnai.html. Additional design considerations that also can be employed are described in Semizarov et al. Proc. Natl. Acad. Sci. 100: 6347-6352.

The term "short hairpin RNA" or "shRNA" refers to an RNA molecule comprising at least two complementary portions hybridized or capable of hybridizing to form a double-stranded (duplex) structure sufficiently long to mediate RNAi (generally between approximately 17 and 29 nucleotides in length, including 17, 18, 19, 20, 21, 22, 23, 24, 25, 26, 27, 28, and 29 nucleotides in length, and in some embodiments, typically at least 19 base pairs in length), and at least one single-stranded portion, typically between approximately 1 and 20 or 1 to 10 nucleotides in length that forms a loop connecting the two nucleotides that form the base pair at one end of the duplex portion. The duplex portion can, but does not require, one or more bulges consisting of one or more unpaired nucleotides. In specific embodiments, the shRNAs comprise a 3' overhang. Thus, shRNAs are precursors of siRNAs and are, in general, similarly capable of inhibiting expression of a target transcript.

In particular, RNA molecules having a hairpin (stem-loop) structure can be processed intracellularly by Dicer to yield an siRNA structure referred to as short hairpin RNAs (shRNAs), which contain two complementary regions that hybridize to one another (self-hybridize) to form a double-stranded (duplex) region referred to as a stem, a single-stranded loop connecting the nucleotides that form the base pair at one end of the duplex, and optionally an overhang, e.g., a 3' overhang. The stem can comprise about 19, 20, or 21 bp long, though shorter and longer stems (e.g., up to about 29 nt) also can be used. The loop can comprise about 1-20, including 1, 2, 3, 4, 5, 6, 7, 8, 9, 10, 11, 12, 13, 14, 15, 16, 17, 18, 19, 20 nt, about 4-10, or about 6-9 nt. The overhang, if present, can comprise approximately 1-20 nt or approximately 2-10 nt. The loop can be located at either the 5' or 3' end of the region that is complementary to the target transcript whose inhibition is desired (i.e., the antisense portion of the shRNA).

Although shRNAs contain a single RNA molecule that self-hybridizes, it will be appreciated that the resulting duplex structure can be considered to comprise sense and antisense strands or portions relative to the target mRNA and can thus be considered to be double-stranded. It will therefore be convenient herein to refer to sense and antisense strands, or sense and antisense portions, of an shRNA, where the antisense strand or portion is that segment of the molecule that forms or is capable of forming a duplex with and is complementary to the targeted portion of the target polynucleotide, and the sense strand or portion is that segment of the molecule that forms or is capable of forming a duplex with the antisense strand or portion and is substantially identical in sequence to the targeted portion of the target transcript. In general, considerations for selection of the sequence of the antisense strand of an shRNA molecule are similar to those for selection of the sequence of the antisense strand of an siRNA molecule that targets the same transcript.

In some embodiments, the silencing element comprises or encodes an antisense oligonucleotide. An "antisense oligonucleotide" is a single-stranded nucleic acid sequence that is wholly or partially complementary to a target gene, and can be DNA, or its RNA counterpart (i.e., wherein T residues of the DNA are U residues in the RNA counterpart).

The antisense oligonucleotides of this invention are designed to be hybridizable with target RNA (e.g., mRNA) or DNA. For example, an oligonucleotide (e.g., DNA oligonucleotide) that hybridizes to a mRNA molecule can be used to target the mRNA for RnaseH digestion. Alternatively, an oligonucleotide that hybridizes to the translation initiation site of an mRNA molecule can be used to prevent translation of the mRNA. In another approach, oligonucleotides that bind to double-stranded DNA can be administered. Such oligonucleotides can form a triplex construct and inhibit the transcription of the DNA. Triple helix pairing prevents the double helix from opening sufficiently to allow the binding of polymerases, transcription factors, or regulatory molecules. Such oligonucleotides of the invention can be constructed using the base-pairing rules of triple helix formation and the nucleotide sequences of the target genes.

As non-limiting examples, antisense oligonucleotides can be targeted to hybridize to the following regions: mRNA cap region, translation initiation site, translational termination site, transcription initiation site, transcription termination site, polyadenylation signal, 3' untranslated region, 5' untranslated region, 5' coding region, mid coding region, and 3' coding region. In some embodiments, the complementary oligonucleotide is designed to hybridize to the most unique 5' sequence of a gene, including any of about 15-35 nucleotides spanning the 5' coding sequence.

Accordingly, the antisense oligonucleotides in accordance with this invention can comprise from about 10 to about 100 nucleotides, including, but not limited to about 10, about 11, about 12, about 13, about 14, about 15, about 16, about 17, about 18, about 19, about 20, about 21, about 22, about 23, about 24, about 25, about 30, about 40, about 50, about 60, about 70, about 80, about 90, or about 100 nucleotides.

Antisense nucleic acids can be produced by standard techniques (see, for example, Shewmaker et al., U.S. Pat. No. 5,107,065). Appropriate oligonucleotides can be designed using OLIGO software (Molecular Biology Insights, Inc., Cascade, Colo.).

According to the methods of the invention, an ALK resistance mutant gene is targeted by a silencing element. As used herein, a target gene or target transcript is "targeted" by a silencing element when the introduction or the expression of the silencing element results in the substantially specific reduction or inhibition in the expression of the target gene and target transcript. The specific region of the target gene or target transcript that has substantial sequence identity or similarity or is complementary to the silencing element is the region that has been "targeted" by the silencing element.

The region of the ALK resistance mutant that is targeted by the silencing element comprises the mutation that confers resistance to at least one ALK kinase inhibitor. In specific embodiments, introduction or expression of the silencing element specifically reduces the level of the ALK resistance mutant, meaning that the expression level of the native or wild type ALK sequence is not affected or minimally affected by the silencing element.

As discussed above, the silencing elements employed in the methods and compositions of the invention can comprise a DNA template for a dsRNA (e.g., shRNA) or antisense RNA or can encode a zinc finger binding protein. In such embodiments, the DNA molecule encoding the dsRNA, antisense RNA, or zinc finger binding protein is found in an expression cassette.

This invention further pertains to novel agents identified by the above-described screening assays and uses thereof as described herein. Briefly, the ALK resistance mutant specific binding agents can be used in methods for the detection of ALK resistance mutants and the diagnosis of cancers that are resistant to or are likely to develop resistance to at least one ALK kinase inhibitor. The ALK resistance mutant inhibitors and silencing elements are useful in the treatment of patients having such cancers.

Various methods and compositions for detecting a polynucleotide encoding ALK resistance mutants or for detecting the ALK resistance mutant polypeptide in a sample (e.g., biological sample) are provided. A biological sample can comprise any sample in which one desires to detect the polynucleotide encoding a particular ALK resistance mutant or the mutant polypeptide. The term "biological sample" is intended to include tissues, cells, and biological fluids isolated from a subject, as well as tissues, cells, and fluids present within a subject or lysates thereof. The sample may comprise any clinically relevant tissue, such as, but not limited to, bone marrow samples, tumor biopsy, fine needle aspirate, or a sample of bodily fluid, such as, blood, plasma, serum, lymph, ascitic fluid, cystic fluid or urine.

Methods for assaying a biological sample for an ALK inhibitor resistance mutation comprise contacting the biological sample with an anti-ALK resistance mutant antibody or other agent that specifically binds to the particular ALK resistance mutant polypeptide, followed by the detection of the binding of the antibody or binding agent to the ALK resistance mutant. The binding of the antibody or the binding agent to the ALK resistance mutant can be detected through the presence of a detectable label (e.g., radioisotope, fluorescent tag, enzymatic tag, chemiluminescent tag) conjugated to the antibody or binding agent or through the use of a labeled secondary antibody or secondary binding agent that specifically binds the ALK-specific binding agent. Non-limiting examples of assays that can be used to detect an ALK resistance mutant polypeptide using a specific binding agent include immunoprecipitation, Western blot, ELISA, immunohistochemistry, immunocytochemistry, and flow cytometry.

The present invention further provides methods for assaying a biological sample for an ALK inhibitor resistance mutation comprising contacting the biological sample with a reagent comprising at least one polynucleotide that can specifically detect or specifically amplify a polynucleotide encoding an ALK inhibitor resistance mutant (e.g., mRNA or genomic DNA), and detecting the polynucleotide that encodes the mutant. The reagent can specifically detect or amplify genomic DNA that encodes the ALK inhibitor resistance mutant or an RNA transcript that encodes the mutant.

In one embodiment, a method for detecting a polynucleotide encoding an ALK resistance mutant polypeptide or active variants and fragments thereof in a sample comprises contacting the sample with a primer pair capable of specifically amplifying an amplicon of a polynucleotide encoding an ALK resistance mutant polypeptide or an active variant or fragment thereof, amplifying and then detecting the amplicon. In certain embodiments, the amplicon is of a sufficient length to specifically detect the polynucleotide encoding the ALK resistance mutant polypeptide or an active variant or fragment thereof.

In other embodiments, a method for detecting a polynucleotide encoding an ALK resistance mutant polypeptide or active variants and fragments thereof in a sample comprises contacting the sample with a polynucleotide capable of specifically detecting a polynucleotide encoding an ALK resistance mutant polypeptide or an active variant or fragment thereof, and detecting the polynucleotide encoding the ALK resistance mutant polypeptide or an active variant or fragment thereof.

In specific embodiments, the sample is contacted with a polynucleotide probe that hybridizes under stringent hybridization conditions to the target sequences to be detected. The sample and probes are then subjected to stringent hybridization conditions and the hybridization of the probe to the target sequences is detected.

As used herein, a "probe" is an isolated polynucleotide to which is attached a conventional detectable label or reporter molecule, e.g., a radioactive isotope, ligand, chemiluminescent agent, enzyme, etc. Such a probe is complementary to a strand of a target polynucleotide, which in specific embodiments of the invention comprise a polynucleotide encoding an ALK resistance mutant. Deoxyribonucleic acid probes may include those generated by PCR using ALK resistance mutant specific primers, oligonucleotide probes synthesized in vitro, or DNA obtained from bacterial artificial chromosome, fosmid or cosmid libraries. Probes include not only deoxyribonucleic or ribonucleic acids but also polyamides and other probe materials that can specifically detect the presence of the target DNA sequence. For nucleic acid probes, examples of detection reagents include, but are not limited to radiolabeled probes, enzymatic labeled probes (horse radish peroxidase, alkaline phosphatase), affinity labeled probes (biotin, avidin, or steptavidin), and fluorescent labeled probes (6-FAM, VIC, TAMRA, MGB, fluorescein, rhodamine, texas red [for BAC/fosmids]). One skilled in the art will readily recognize that the nucleic acid probes described in the present invention can readily be incorporated into one of the established kit formats which are well known in the art.

As used herein, "primers" are isolated polynucleotides that are annealed to a complementary target DNA strand by nucleic acid hybridization to form a hybrid between the primer and the target DNA strand, then extended along the target DNA strand by a polymerase, e.g., a DNA polymerase. Primer pairs of the invention refer to their use for amplification of a target polynucleotide, e.g., by the polymerase chain reaction (PCR) or other conventional nucleic-acid amplification methods. "PCR" or "polymerase chain reaction" is a technique used for the amplification of specific DNA segments (see, U.S. Pat. Nos. 4,683,195 and 4,800,159; herein incorporated by reference).

By "specifically detect" is intended that the polynucleotide can be used as a probe that hybridizes under stringent conditions to a polynucleotide encoding an ALK resistance mutant or the polynucleotide can be used in nucleic acid sequencing techniques to sequence the region comprising the ALK resistance mutant. By "specifically amplify" is intended that the polynucleotide(s) can be used as a primer to specifically amplify an amplicon of a polynucleotide encoding an ALK resistance mutant. The level or degree of hybridization which allows for the specific detection of a polynucleotide encoding an ALK resistance mutant is sufficient to distinguish the polynucleotide encoding the ALK resistance mutant from a polynucleotide that does not encode the recited polypeptide (e.g., native AKT; SEQ ID NO:1). By "shares sufficient sequence identity or complementarity to allow for the amplification of a polynucleotide encoding an ALK resistance mutant" is intended the sequence shares at least 80%, 85%, 90%, 91%, 92%, 93%, 94%, 95%, 96%, 97%, 98%, 99% or 100% identity or complementarity to a fragment or across the full length of the polynucleotide encoding the ALK resistance mutant.

Probes and primers are of sufficient nucleotide length to bind to the target DNA sequence and specifically detect and/or amplify a polynucleotide encoding an ALK resistance mutant. It is recognized that the hybridization conditions or reaction conditions can be determined by the operator to achieve this result. This length may be of any length that is of sufficient length to be useful in a detection method of choice. Generally, 8, 11, 14, 16, 18, 20, 22, 24, 26, 28, 30, 40, 50, 75, 100, 200, 300, 400, 500, 600, 700 nucleotides or more, or between about 11-20, 20-30, 30-40, 40-50, 50-100, 100-200, 200-300, 300-400, 400-500, 500-600, 600-700, 700-800, or more nucleotides in length are used.

As used herein, "amplified DNA" or "amplicon" refers to the product of polynucleotide amplification of a target polynucleotide that is part of a nucleic acid template. For example, to determine whether the biological sample comprises an ALK resistance mutation, the nucleic acid complement of the biological sample may be subjected to a polynucleotide amplification method using a primer pair that includes a first primer derived from the 5' flanking sequence adjacent to an ALK resistance mutation, and a second primer derived from the 3' flanking sequence adjacent to the ALK resistance mutation to produce an amplicon that is capable of distinguishing the ALK resistance mutant from native or wild-type ALK. The amplified polynucleotide (amplicon) can be of any length that allows for the detection of the polynucleotide encoding the ALK resistance mutant. For example, the amplicon can be about 10, 50, 100, 200, 300, 500, 700, 100, 2000, 3000, 4000 nucleotides in length or longer. Further, in some embodiments, the length or sequence of the amplified region (amplicon) of the polynucleotide encoding the ALK resistance mutant that allows for the specific detection of the polynucleotide is sufficient to distinguish the polynucleotide encoding the ALK resistance mutant from a polynucleotide that does not encode the recited polypeptide. A member of a primer pair derived from the flanking sequence may be located a distance from the resistance mutation. This distance can range from one nucleotide base pair up to the limits of the amplification reaction, or about twenty thousand nucleotide base pairs. The use of the term "amplicon" specifically excludes primer dimers that may be formed in the DNA thermal amplification reaction.

Methods for preparing and using probes and primers are described, for example, in *Molecular Cloning: A Laboratory Manual,* 2.sup.nd ed, vol. 1-3, ed. Sambrook et al., Cold Spring Harbor Laboratory Press, Cold Spring Harbor, N.Y. 1989 (hereinafter, "Sambrook et al., 1989"); *Current Protocols in Molecular Biology*, ed. Ausubel et al., Greene Publishing and Wiley-Interscience, New York, 1992 (with periodic updates) (hereinafter, "Ausubel et al., 1992"); and Innis et al., PCR Protocols: A Guide to Methods and Applications, Academic Press: San Diego, 1990. PCR primer pairs can be derived from a known sequence, for example, by using computer programs intended for that purpose such as the PCR primer analysis tool in Vector NTI version 10 (Informax Inc., Bethesda Md.); PrimerSelect (DNASTAR Inc., Madison, Wis.); and Primer3 (Version 0.4.0.COPYRGT., 1991, Whitehead Institute for Biomedical Research, Cambridge, Mass.). Additionally, the sequence can be visually scanned and primers manually identified using guidelines known to one of skill in the art.

The ALK inhibitor resistance mutation may be detected using a variety of nucleic acid techniques known to those of ordinary skill in the art, including but not limited to: nucleic acid sequencing; nucleic acid hybridization; and, nucleic acid amplification.

Illustrative non-limiting examples of nucleic acid sequencing techniques include, but are not limited to, chain terminator (Sanger) sequencing and dye terminator sequencing. Chain terminator sequencing uses sequence-specific termination of a DNA synthesis reaction using modified nucleotide substrates. Extension is initiated at a specific site on the template DNA by using a short radioactive, or other labeled, oligonucleotide primer complementary to the template at that region. The oligonucleotide primer is extended using a DNA polymerase, standard four deoxynucleotide bases, and a low concentration of one chain terminating nucleotide, most commonly a di-deoxynucleotide. This reaction is repeated in four separate tubes with each of the bases taking turns as the di-deoxynucleotide. Limited incorporation of the chain terminating nucleotide by the DNA polymerase results in a series of related DNA fragments that are terminated only at positions where that particular di-deoxynucleotide is used. For each reaction tube, the fragments are size-separated by electrophoresis in a slab polyacrylamide gel or a capillary tube filled with a viscous polymer. The sequence is determined by reading which lane produces a visualized mark from the labeled primer as you scan from the top of the gel to the bottom. Dye terminator sequencing alternatively labels the terminators. Complete sequencing can be performed in a single reaction by labeling each of the di-deoxynucleotide chain-terminators with a separate fluorescent dye, which fluoresces at a different wavelength.

The present invention further provides methods for assaying a biological sample for an ALK resistance mutation using nucleic acid hybridization techniques. Nucleic acid hybridization includes methods using labeled probes directed against purified DNA, amplified DNA, and fixed cell preparations (fluorescence in situ hybridization). Non-limiting examples of nucleic acid hybridization techniques include the known methods of Southern (DNA:DNA) blot hybridizations, in situ hybridization and FISH of chromosomal material, using appropriate probes. Such nucleic acid probes can be used that comprise nucleotide sequences in proximity to the ALK resistance mutation. By "in proximity to" is intended within about 100 kilobases (kb) of the ALK resistance mutation.

In situ hybridization (ISH) is a type of hybridization that uses a labeled complementary DNA or RNA strand as a probe to localize a specific DNA or RNA sequence in a portion or section of tissue (in situ), or, if the tissue is small enough, the entire tissue (whole mount ISH). DNA ISH can be used to determine the structure of chromosomes. Sample cells and tissues are usually treated to fix the target transcripts in place and to increase access of the probe. The probe hybridizes to the target sequence at elevated temperature, and then the excess probe is washed away. The probe that was labeled with either radio-, fluorescent- or antigen-labeled bases is localized and quantitated in the tissue using either autoradiography, fluorescence microscopy or immunohistochemistry, respectively. ISH can also use two or more probes, labeled with radioactivity or the other non-radioactive labels, to simultaneously detect two or more transcripts. In some embodiments, the ALK resistance mutant is detected using fluorescence in situ hybridization (FISH).

Specific protocols for nucleic acid hybridization are well known in the art and can be readily adapted for the present invention. Guidance regarding methodology may be obtained from many references including: In situ Hybridization: Medical Applications (eds. G. R. Coulton and J. de Belleroche), Kluwer Academic Publishers, Boston (1992); In situ Hybridization: hi Neurobiology; Advances in Methodology (eds. J. H. Eberwine, K. L. Valentino, and J. D. Barchas), Oxford University Press Inc., England (1994); In situ Hybridization: A Practical Approach (ed. D. G. Wilkinson), Oxford University Press Inc., England (1992)); Kuo et al. (1991) *Am. J. Hum. Genet.* 42:112-119; Klinger et al. (1992) *Am. J. Hum. Genet.* 51:55-65; and Ward et al. (1993) *Am. J. Hum. Genet.* 52:854-865). There are also kits that are commercially available and that provide protocols for performing FISH assays (available from e.g., Oncor, Inc., Gaithersburg, Md.). Patents providing guidance on methodology include U.S. Pat. Nos. 5,225,326; 5,545,524; 6,121,489 and 6,573,043. All of these references are hereby incorporated by reference in their entirety and may be used along with similar references in the art.

Southern blotting can be used to detect specific DNA sequences. In such methods, DNA that is extracted from a sample is fragmented, electrophoretically separated on a matrix gel, and transferred to a membrane filter. The filter bound DNA is subject to hybridization with a labeled probe complementary to the sequence of interest. Hybridized probe bound to the filter is detected. Further, Northern blotting techniques that are known in the art can be used to detect specific RNA sequences that encode an ALK resistance mutant.

Microarrays may also be used to specifically detect an ALK resistance polynucleotide. Each array consists of a reproducible pattern of capture probes attached to a solid support. Labeled RNA is hybridized to complementary probes on the array and then detected by laser scanning. Hybridization intensities for each probe on the array are determined and converted to a quantitative value representing relative gene expression levels. See, for example, U.S. Pat. Nos. 6,040,138, 5,800,992 and 6,020,135, 6,033,860, and 6,344,316, each of which is herein incorporated by reference in its entirety.

In hybridization techniques, all or part of a polynucleotide that selectively hybridizes to a target polynucleotide encoding an ALK resistance mutant polypeptide is employed. By "stringent conditions" or "stringent hybridization conditions" when referring to a polynucleotide probe is intended conditions under which a probe will hybridize to its target sequence to a detectably greater degree than to other sequences (e.g., at least 2-fold over background). Stringent conditions are sequence-dependent and will be different in different circumstances. By controlling the stringency of the hybridization and/or washing conditions, target sequences that are 100% complementary to the probe can be identified (homologous probing). Alternatively, stringency conditions can be adjusted to allow some mismatching in sequences so that lower degrees of identity are detected (heterologous probing). Generally, a probe is less than about 1000 nucleotides in length or less than 500 nucleotides in length.

As used herein, a substantially identical or complementary sequence is a polynucleotide that will specifically hybridize to the complement of the nucleic acid molecule to which it is being compared under high stringency conditions. Appropriate stringency conditions which promote DNA hybridization, for example, 6× sodium chloride/sodium citrate (SSC) at about 45° C., followed by a wash of 2×SSC at 50° C., are known to those skilled in the art or can be found in *Current Protocols in Molecular Biology*, John Wiley & Sons, N.Y. (1989), 6.3.1-6.3.6. Typically, stringent conditions for hybridization and detection will be those in which the salt concentration is less than about 1.5 M Na ion, typically about 0.01 to 1.0 M Na ion concentration (or other salts) at pH 7.0 to 8.3 and the temperature is at least about 30° C. for short probes (e.g., 10 to 50 nucleotides) and at least about 60° C. for long probes (e.g., greater than 50 nucleotides). Stringent conditions may also be achieved with the addition of destabilizing agents such as formamide. Exemplary low stringency conditions include hybridization with a buffer solution of 30 to 35% formamide, 1 M NaCl, 1% SDS (sodium dodecyl sulphate) at 37° C., and a wash in 1× to 2×SSC (20×SSC=3.0 M NaCl/0.3 M trisodium citrate) at 50 to 55° C. Exemplary moderate stringency conditions include hybridization in 40 to 45% formamide, 1.0 M NaCl, 1% SDS at 37° C., and a wash in 0.5× to 1×SSC at 55 to 60° C. Exemplary high stringency conditions include hybridization in 50% formamide, 1 M NaCl, 1% SDS at 37° C., and a wash in 0.1×SSC at 60 to 65° C. Optionally, wash buffers may comprise about 0.1% to about 1% SDS. Duration of hybridization is generally less than about 24 hours, usually about 4 to about 12 hours. The duration of the wash time will be at least a length of time sufficient to reach equilibrium.

In hybridization reactions, specificity is typically the function of post-hybridization washes, the critical factors being the ionic strength and temperature of the final wash solution. For DNA-DNA hybrids, the $T_m$ can be approximated from the equation of Meinkoth and Wahl (1984) *Anal. Biochem.* 138: 267-284: $T_m$=81.5° C.+16.6 (log M)+0.41 (% GC)−0.61 (% form)−500/L; where M is the molarity of monovalent cations, % GC is the percentage of guanosine and cytosine nucleotides in the DNA, % form is the percentage of formamide in the hybridization solution, and L is the length of the hybrid in base pairs. The $T_m$ is the temperature (under defined ionic strength and pH) at which 50% of a complementary target sequence hybridizes to a perfectly matched probe. $T_m$ is reduced by about 1° C. for each 1% of mismatching; thus, $T_m$, hybridization, and/or wash conditions can be adjusted to hybridize to sequences of the desired identity. For example, if sequences with ≧90% identity are sought, the $T_m$ can be decreased 10° C. Generally, stringent conditions are selected to be about 5° C. lower than the thermal melting point ($T_m$) for the specific sequence and its complement at a defined ionic strength and pH. However, severely stringent conditions can utilize a hybridization and/or wash at 1, 2, 3, or 4° C. lower than the thermal melting point ($T_m$); moderately stringent conditions can utilize a hybridization and/or wash at 6, 7, 8, 9, or 10° C. lower than the thermal melting point ($T_m$); low stringency conditions can utilize a hybridization and/or wash at 11, 12, 13, 14, 15, or 20° C. lower than the thermal melting point ($T_m$). Using the equation, hybridization and wash compositions, and desired $T_m$, those of ordinary skill will understand that variations in the stringency of hybridization and/or wash solutions are inherently described. If the desired degree of mismatching results in a $T_m$ of less than 45° C. (aqueous solution) or 32° C. (formamide solution), it is optimal to increase the SSC concentration so that a higher temperature can be used. An extensive guide to the hybridization of nucleic acids is found in Tijssen (1993) *Laboratory Techniques in Biochemistry and Molecular Biology—Hybridization with Nucleic Acid Probes*, Part I, Chapter 2 (Elsevier, New York); and Ausubel et al., eds. (1995) *Current Protocols in Molecular Biology*, Chapter 2 (Greene Publishing and Wiley-Interscience, New York). See Sambrook et al. (1989) *Molecular Cloning: A Laboratory Manual* (2d ed., Cold Spring Harbor Laboratory Press, Plainview, N.Y.) and Haymes et al. (1985) In: *Nucleic Acid Hybridization*, a Practical Approach, IRL Press, Washington, D.C.

Illustrative non-limiting examples of nucleic acid amplification techniques include, but are not limited to, polymerase chain reaction (PCR), reverse transcription-polymerase chain reaction (RT-PCR), ligase chain reaction (LCR) (Weiss (1991) *Science* 254: 1292, herein incorporated by reference in its entirety), strand displacement amplification (SDA) (Walker et al. (1992) *Proc. Natl. Acad. Sci. USA* 89: 392-396; U.S. Pat. Nos. 5,270,184 and 5,455,166, each of which is herein incorporated by reference in its entirety), and nucleic acid sequence based amplification (NASBA). The polymerase chain reaction (U.S. Pat. Nos. 4,683,195, 4,683,202, 4,800,159 and 4,965,188, each of which is herein incorporated by reference in its entirety), commonly referred to as PCR, uses multiple cycles of denaturation, annealing of primer pairs to opposite strands, and primer extension to exponentially increase copy numbers of a target nucleic acid sequence. For other various permutations of PCR see, e.g., U.S. Pat. Nos. 4,683,195, 4,683,202 and 4,800,159; Mullis et al, (1987) *Meth. Enzymol.* 155: 335; and, Murakawa et al., (1988) *DNA* 7: 287, each of which is herein incorporated by reference in its entirety.

Methods for designing PCR primers and PCR cloning are generally known in the art and are disclosed in Sambrook et al. (1989) *Molecular Cloning: A Laboratory Manual* (2d ed., Cold Spring Harbor Laboratory Press, Plainview, N.Y.). See also Innis et al., eds. (1990) *PCR Protocols: A Guide to Methods and Applications* (Academic Press, New York); Innis and Gelfand, eds. (1995) *PCR Strategies* (Academic Press, New York); and Innis and Gelfand, eds. (1999) *PCR Methods Manual* (Academic Press, New York). Methods of amplification are further described in U.S. Pat. Nos. 4,683,195, 4,683,202 and Chen et al. (1994) *PNAS* 91:5695-5699. These methods as well as other methods known in the art of DNA amplification may be used in the practice of the embodiments of the present invention. It is understood that a number of parameters in a specific PCR protocol may need to be adjusted to specific laboratory conditions and may be slightly modified and yet allow for the collection of similar results. These adjustments will be apparent to a person skilled in the art. Thermal cyclers are often employed for the specific amplification of polynucleotides. The cycles of denaturation, annealing and polymerization for PCR may be performed using an automated device, typically known as a thermal cycler. Thermal cyclers that may be employed are described in U.S. Pat. Nos. 5,612,473; 5,602,756; 5,538,871; and 5,475,610, the disclosures of which are herein incorporated by reference.

One illustrative detection method provides for quantitative evaluation of the amplification process in real-time. Evaluation of an amplification process in "real-time" involves determining the amount of amplicon in the reaction mixture either continuously or periodically during the amplification reaction, and using the determined values to calculate the amount of target sequence initially present in the sample. A variety of methods for determining the amount of initial target sequence present in a sample based on real-time amplification are well known in the art. These include methods disclosed in U.S. Pat. Nos. 6,303,305 and 6,541,205, each of which is herein incorporated by reference in its entirety. Another method for determining the quantity of target sequence initially present in a sample, but which is not based on a real-time amplification, is disclosed in U.S. Pat. No. 5,710,029, herein incorporated by reference in its entirety.

Amplification products may be detected in real-time through the use of various self-hybridizing probes, most of which have a stem-loop structure. Such self-hybridizing probes are labeled so that they emit differently detectable signals, depending on whether the probes are in a self-hybridized state or an altered state through hybridization to a target sequence. By way of non-limiting example, "molecular torches" are a type of self-hybridizing probe that includes distinct regions of self-complementarity (referred to as "the target binding domain" and "the target closing domain") which are connected by a joining region (e.g., non-nucleotide linker) and which hybridize to each other under predetermined hybridization assay conditions. Molecular torches and a variety of types of interacting label pairs are disclosed in U.S. Pat. No. 6,534,274, herein incorporated by reference in its entirety.

Another example of a detection probe having self-complementarity is a "molecular beacon." Molecular beacons include nucleic acid molecules having a target complementary sequence, an affinity pair (or nucleic acid arms) holding the probe in a closed conformation in the absence of a target sequence present in an amplification reaction, and a label pair that interacts when the probe is in a closed conformation. Hybridization of the target sequence and the target complementary sequence separates the members of the affinity pair, thereby shifting the probe to an open conformation. The shift to the open conformation is detectable due to reduced interaction of the label pair, which may be, for example, a fluorophore and a quencher (e.g., DABCYL and EDANS). Molecular beacons are disclosed in U.S. Pat. Nos. 5,925,517 and 6,150,097, herein incorporated by reference in its entirety.

Other self-hybridizing probes are well known to those of ordinary skill in the art. By way of non-limiting example, probe binding pairs having interacting labels, such as those disclosed in U.S. Pat. No. 5,928,862 (herein incorporated by reference in its entirety) might be adapted for use in the present invention. Probe systems used to detect single nucleotide polymorphisms (SNPs) might also be utilized in the present invention. Additional detection systems include "molecular switches," as disclosed in U.S. Publ. No. 20050042638, herein incorporated by reference in its entirety. Other probes, such as those comprising intercalating dyes and/or fluorochromes, are also useful for detection of amplification products in the present invention. See, e.g., U.S. Pat. No. 5,814,447 (herein incorporated by reference in its entirety).

Agents that can be used to specifically detect a presently disclosed ALK resistance mutant can be provided in a kit. As used herein, "kit" refers to a set of reagents for the identification, the detection, and/or the quantification of the polynucleotide encoding an ALK resistance mutant polypeptide or detection and/or quantitation of the ALK resistance mutant polypeptide in biological samples. The terms "kit" and "system," as used herein are intended to refer to at least one or more detection reagents which, in specific embodiments, are in combination with one or more other types of elements or components (e.g., other types of biochemical reagents, containers, packages, such as packaging intended for commercial sale, substrates to which detection reagents are attached, electronic hardware components, instructions of use, and the like). Accordingly, the present invention further provides ALK resistance mutant detection kits and systems, including but not limited to, packaged probe and primer sets (e.g., TaqMan probe/primer sets), arrays/microarrays of nucleic acid molecules, and beads that contain one or more probes, primers, or other detection reagents for detecting one or more ALK resistance mutant. The kits/systems can optionally include various electronic hardware components. For example, arrays (e.g., DNA chips) and microfluidic systems (e.g., lab-on-a-chip systems) provided by various manufacturers typically include hardware components. Other kits/systems (e.g., probe/primer sets) may not include electronic hardware components, but can include, for example, one or more ALK resistance mutant detection reagents along with other biochemical reagents packaged in one or more containers.

In some embodiments, an ALK resistance mutant detection kit typically contains one or more detection reagents and other components (e.g., a buffer, enzymes, such as DNA polymerases or ligases, chain extension nucleotides, such as deoxynucleotide triphosphates, positive control sequences, negative control sequences, and the like) necessary to carry out an assay or reaction, such as amplification and/or detection of a polynucleotide comprising an ALK resistance mutation. A kit can further contain means for determining the amount of the target polynucleotide and means for comparing with an appropriate standard, and can include instructions for using the kit to detect the ALK resistance mutation. In one embodiment, kits are provided which contain the necessary reagents to carry out one or more assays to detect one or more of the ALK resistance mutations as disclosed herein. The ALK resistance mutation detection kits/systems may contain, for example, one or more probes, or pairs of probes, that hybridize to a nucleic acid molecule at or near the ALK resistance mutation.

In specific embodiments, the kit comprises a first and a second primer, wherein the first and second primer amplify an amplicon comprising an ALK inhibitor resistance mutation. In other embodiments, the kit comprises at least one probe comprising a polynucleotide sequence that hybridizes under stringent conditions to a polynucleotide encoding an ALK having an inhibitor resistance mutation.

Kits can also be used to detect an ALK inhibitor resistance mutant polypeptide. In these embodiments, kits comprise an agent that specifically binds an ALK resistance mutant polypeptide, such as an antibody, in combination with one or more other types of elements or components (e.g., other types of biochemical reagents, containers, packages, such as packaging intended for commercial sale, electronic hardware components, wash reagents, reagents/chemical capable of detecting the presence of bounds specific binding agents, such as antibodies, of the kit).

In specific embodiments, the kit comprises a compartmentalized kit and includes any kit in which reagents are contained in separate containers. Such containers include small glass containers, plastic containers or strips of plastic or paper. Such containers allow one to efficiently transfer reagents from one compartment to another compartment such that the samples and reagents are not cross-contaminated, and the agents or solutions of each container can be added in a quantitative fashion from one compartment to another. Such containers may include a container which will accept the test sample, a container which contains the antibodies or probes used in the assay, containers which contain wash reagents (such as phosphate buffered saline, Tris-buffers, etc.), and containers which contain the reagents used to detect the bound antibody or the hybridized probe. Any detection reagents known in the art can be used including, but not limited to those described supra.

The methods for detecting an ALK resistance mutant can be used to diagnose a disease associated with aberrant ALK activity in a subject. Further, agents that inhibit the ALK resistance mutants that have been identified using the screening assays described herein can be used to treat such diseases. Diseases mediated by ALK activity include, but are not limited to, diseases characterized in part by migration, invasion, proliferation and other biological activities associated with invasive cell growth. Such diseases include cancers. Thus, methods for diagnosing the presence of a cancer that is resistant to or likely to develop resistance to at least one ALK kinase inhibitor in a subject are provided. Such methods can comprise assaying a biological sample from a subject for the presence of an ALK inhibitor resistance mutation using any of the aforementioned methods, such as detecting the ALK resistance mutant polypeptide with a specific binding agent (e.g., antibody) or detecting the ALK resistant mutation using a polynucleotide capable of detecting the same.

The term "cancer" refers to the condition in a subject that is characterized by unregulated cell growth, wherein the cancerous cells are capable of local invasion and/or metastasis to noncontiguous sites. As used herein, "cancer cells," "cancerous cells," or "tumor cells" refer to the cells that are characterized by this unregulated cell growth and invasive property.

The term "cancer" encompasses all types of cancers, including, but not limited to, all forms of carcinomas, melanomas, sarcomas, lymphomas and leukemias, including without limitation, cancers of the cardiac system: sarcoma (angiosarcoma, fibrosarcoma, rhabdomyosarcoma, liposarcoma), myxoma, rhabdomyoma, fibroma, lipoma and teratoma; cancers of the lung: bronchogenic carcinoma (squamous cell, undifferentiated small cell, undifferentiated large cell, adenocarcinoma), alveolar (bronchiolar) carcinoma, bronchial adenoma, sarcoma, lymphoma, chondromatous hanlartoma, inesothelioma; cancers of the gastrointestinal system: esophagus (squamous cell carcinoma, adenocarcinoma, leiomyosarcoma, lymphoma), stomach (carcinoma, lymphoma, leiomyosarcoma), pancreas (ductal adenocarcinoma, insulinoma, glucagonoma, gastrinoma, carcinoid tumors, vipoma), small bowel (adenocarcinoma, lymphoma, carcinoid tumors, Karposi's sarcoma, leiomyoma, hemangioma, lipoma, neurofibroma, fibroma), large bowel (adenocarcinoma, tubular adenoma, villous adenoma, hamartoma, leiomyoma); cancers of the genitourinary tract: kidney (adenocarcinoma, Wilm's tumor [neplrroblastoma], lymphoma, leukemia), bladder and urethra (squamous cell carcinoma, transitional cell carcinoma, adenocarcinoma), prostate (adenocarcinoma, sarcoma), testis (seminoma, teratoma, embryonal carcinoma, teratocarcinoma, choriocarcinoma, sarcoma, interstitial cell carcinoma, fibroma, fibroadenoma, adenomatoid tumors, lipoma); cancers of the liver: hepatoma (hepatocellular carcinoma), cholangiocarcinoma, hepatoblastoma, angiosarcoma, hepatocellular adenoma, hemangioma; cancers of the bone: osteogenic sarcoma (osteosarcoma), fibrosarcoma, malignant fibrous histiocytoma, chondrosarcoma, Ewing's sarcoma, malignant lymphoma (reticulum cell sarcoma), multiple myeloma, malignant giant cell tumor chordoma, osteochronfroma (osteocartilaginous exostoses), benign chondroma, chondroblastoma, chondromyxofibroma, osteoid osteoma and giant cell tumors; cancers of the nervous system: skull (osteoma, hemangioma, granuloma, xanthoma, osteitis deformians), meninges (meningioma, meningiosarcoma, gliomatosis), brain (astrocytoma, medulloblastoma, glioma, ependymoma, germinoma [pinealoma], glioblastoma multiform, oligodendroglioma, schwannoma, retinoblastoma, congenital tumors), spinal cord neurofibroma, meningioma, glioma, sarcoma); gynecological cancers: uterus (endometrial carcinoma), cervix (cervical carcinoma, pre-tumor cervical dysplasia), ovaries (ovarian carcinoma [serous cystadenocarcinoma, mucinous cystadenocarcinoma, unclassified carcinoma], granulosa-thecal cell tumors, Sertoli Leydig cell tumors, dysgerminoma, malignant teratoma), vulva (squamous cell carcinoma, intraepithelial carcinoma, adenocarcinoma, fibrosarcoma, melanoma), vagina (clear cell carcinoma, squamous cell carcinoma, botryoid sarcoma (embryonal rhabdomyosarcoma), fallopian tubes (carcinoma); hematologic cancers: blood (myeloid leukemia [acute and chronic], acute lymphoblastic leukemia, chronic lymphocytic leukemia, myeloproliferative diseases, multiple myeloma, myelodysplastic syndrome), Hodgkin's disease, non-Hodgkin's lymphoma [malignant lymphoma], anaplastic large cell lymphoma (ALCL); skin cancers: malignant melanoma, basal cell carcinoma, squamous cell carcinoma, Karposi's sarcoma, moles dysplastic nevi, lipoma, angioma, dermatofibroma, keloids, psoriasis; and cancers of the adrenal glands: neuroblastoma.

In certain embodiments, the cancer is a large B-cell lymphoma, malignant histiocytosis, an inflammatory myofibroblastic tumor sarcoma, an esophageal squamous cell carcinoma, a breast cancer, a colorectal carcinoma, a non-small cell lung carcinoma, a neuroblastoma, a bladder cancer, a renal cancer, and a glioblastoma.

By "subject" is intended mammals, e.g., primates, humans, agricultural and domesticated animals such as, but not limited to, dogs, cats, cattle, horses, pigs, sheep, and the like. In some embodiments, the subject that is being diagnosed or treated is a human.

The methods can be used to diagnose a cancer in a subject not previously known to have a cancer through the detection of an ALK oncogenic fusion protein having an ALK inhibitor resistance mutation or a polynucleotide encoding the same using the detection methods disclosed herein.

The methods can also be used to diagnose a cancer that is resistant to or likely to develop resistance to at least one ALK kinase inhibitor in a subject that was previously known to have a cancer that is associated with aberrant ALK activity through the detection of an ALK inhibitor resistance mutant polypeptide or polynucleotide encoding the same using the detection methods disclosed herein. In these embodiments, the ALK inhibitor resistance mutant does not necessarily have to be part of an ALK oncogenic fusion protein, as genomic amplifications or protein overexpression can lead to aberrant ALK activity and cancer development. Therefore, "aberrant ALK activity" refers to an increased ALK activity (that can be due to genomic amplification, protein overexpression or overactivation, or the presence of a consitutively active ALK oncogenic fusion protein) that is sufficient to contribute to the development and/or maintenance of a cancerous state. Accordingly, a cancer that is associated with aberrant ALK activity is one wherein the aberrant ALK activity contributes to the development and/or growth of the cancer.

The ALK resistance mutant inhibitors that are identified through the methods disclosed herein can be used in the treatment of cancers having an ALK resistance mutation. Additionally, agents that reduce the expression of ALK resistance mutants (e.g., silencing elements) can be used to treat cancers having an ALK resistance mutation.

As used herein, "treatment" is an approach for obtaining beneficial or desired clinical results. For purposes of this invention, beneficial or desired clinical results include, but are not limited to, alleviation of symptoms, partial or complete restoration of eyesight (e.g., central vision, visual acuity), diminishment of extent of the disorder, stabilized (i.e., not worsening) state of the disorder (e.g., degeneration of cone photoreceptors), delaying or slowing of progression of the disorder, amelioration or palliation of the disorder, and prevention of, inhibition of, or reduction of risk of developing a retinal disorder. "Treatment" refers to both therapeutic treatment and prophylactic or preventative measures. Those in need of treatment include those already with the disorder (to prevent further degeneration) as well as those in which the disorder is to be prevented. "Palliating" a disorder means that the extent and/or undesirable clinical manifestations of the disorder are lessened and/or the time course of the progression is slowed or lengthened, as compared to a situation without treatment.

In some embodiments, the ALK resistance mutant inhibitor is administered along with a pharmaceutically acceptable carrier, which is referred to herein as a pharmaceutical composition. As used herein the term "pharmaceutically acceptable carrier" includes solvents, dispersion media, antibacterial and antifungal agents, isotonic agents, and the like, compatible with pharmaceutical administration. Supplementary active compounds also can be incorporated into the compositions.

A pharmaceutical composition of the invention is formulated to be compatible with its intended route of administration. Examples of routes of administration include parenteral, e.g., intravenous, intradermal, subcutaneous, oral (e.g., inhalation), transdermal (topical), transmucosal, and rectal administration. In addition, it may be desirable to administer a therapeutically effective amount of the pharmaceutical composition locally to an area in need of treatment (e.g., to an area of the body where inhibiting a $T_R$ cell function is desired). This can be achieved by, for example, local or regional infusion or perfusion during surgery, topical application, injection, catheter, suppository, or implant (for example, implants formed from porous, non-porous, or gelatinous materials, including membranes, such as sialastic membranes or fibers), and the like. In one embodiment, administration can be by direct injection at the site (or former site) of a cancer that is to be treated. In another embodiment, the therapeutically effective amount of the pharmaceutical composition is delivered in a vesicle, such as liposomes (see, e.g., Langer (1990) *Science* 249:1527-33; and Treat et al., in *Liposomes in the Therapy of Infectious Disease and Cancer*, Lopez Berestein and Fidler (eds.), Liss, N.Y., pp. 353-65, 1989).

In yet another embodiment, the therapeutically effective amount of the pharmaceutical composition can be delivered in a controlled release system. In one example, a pump can be used (see, e.g., Langer (1990) *Science* 249:1527-33; Sefton (1987) *Crit. Rev. Biomed. Eng.* 14:201-40; Buchwald et al. (1980) *Surgery* 88:507-16; Saudek et al. (1989) *N. Engl. J. Med.* 321:574-79). In another example, polymeric materials can be used (see, e.g., Levy et al. (1985) *Science* 228:190-92; During et al. (1989) *Ann. Neurol.* 25:351-56; Howard et al. (1989) *J. Neurosurg.* 71:105-12). Other controlled release systems, such as those discussed by Langer (1990) *Science* 249:1527-33, can also be used.

Solutions or suspensions used for parenteral, intradermal, or subcutaneous application can include the following components: a sterile diluent such as water for injection, saline solution, fixed oils, polyethylene glycols, glycerine, propylene glycol or other synthetic solvents; antibacterial agents such as benzyl alcohol or methyl parabens; antioxidants such as ascorbic acid or sodium bisulfite; chelating agents such as ethylenediaminetetraacetic acid; buffers such as acetates, citrates or phosphates and agents for the adjustment of tonicity such as sodium chloride or dextrose. pH can be adjusted with acids or bases, such as hydrochloric acid or sodium hydroxide. The parenteral preparation can be enclosed in ampoules, disposable syringes, or multiple dose vials made of glass or plastic.

Pharmaceutical compositions suitable for injectable use include sterile aqueous solutions (where water soluble) or dispersions and sterile powders for the extemporaneous preparation of sterile injectable solutions or dispersions. For intravenous administration, suitable carriers include physiological saline, bacteriostatic water, Cremophor® EL (BASF; Parsippany, N.J.), or phosphate buffered saline (PBS). In all cases, the composition must be sterile and should be fluid to the extent that easy syringability exists. It must be stable under the conditions of manufacture and storage and must be preserved against the contaminating action of microorganisms such as bacteria and fungi. The carrier can be a solvent or dispersion medium containing, for example, water, ethanol, polyol (for example, glycerol, propylene glycol, and liquid polyetheylene glycol, and the like), and suitable mixtures thereof. The proper fluidity can be maintained, for example, by the use of a coating such as lecithin, by the maintenance of the required particle size in the case of dispersion, and by the use of surfactants. Prevention of the action of microorganisms can be achieved by various antibacterial and antifungal agents, for example, parabens, chlorobutanol, phenol, ascorbic acid, thimerosal, and the like. In many cases, it will be preferable to include isotonic agents, for example, sugars, polyalcohols such as mannitol, sorbitol, sodium chloride, in the composition. Prolonged absorption of the injectable compositions can be brought about by including in the composition an agent that delays absorption, for example, aluminum monostearate and gelatin.

Sterile injectable solutions can be prepared by incorporating the active compound in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying, which yields a powder of the active ingredient plus any additional desired ingredient from a previously sterile-filtered solution thereof.

Oral compositions generally include an inert diluent or an edible carrier. They can be enclosed in gelatin capsules or compressed into tablets. For the purpose of oral therapeutic administration, the active compound can be incorporated with excipients and used in the form of tablets, troches, or capsules. Oral compositions can also be prepared using a fluid carrier for use as a mouthwash, wherein the compound in the fluid carrier is applied orally and swished and expectorated or swallowed. Pharmaceutically compatible binding agents, and/or adjuvant materials can be included as part of the composition. The tablets, pills, capsules, troches and the like can contain any of the following ingredients, or compounds of a similar nature: a binder such as microcrystalline cellulose, gum tragacanth, or gelatin; an excipient such as starch or lactose, a disintegrating agent such as alginic acid, Primogel, or corn starch; a lubricant such as magnesium stearate or Sterotes; a glidant such as colloidal silicon dioxide; a sweetening agent such as sucrose or saccharin; or a flavoring agent such as peppermint, methyl salicylate, or orange flavoring. For administration by inhalation, the compounds are delivered in the form of an aerosol spray from a pressurized container or dispenser that contains a suitable propellant, e.g., a gas such as carbon dioxide, or a nebulizer.

Systemic administration can also be by transmucosal or transdermal means. For transmucosal or transdermal administration, penetrants appropriate to the barrier to be permeated are used in the formulation. Such penetrants are generally known in the art, and include, for example, for transmucosal administration, detergents, bile salts, and fusidic acid derivatives. Transmucosal administration can be accomplished through the use of nasal sprays or suppositories. For transdermal administration, the active compounds are formulated into ointments, salves, gels, or creams as generally known in the art. The compounds can also be prepared in the form of suppositories (e.g., with conventional suppository bases such as cocoa butter and other glycerides) or retention enemas for rectal delivery.

In one embodiment, the active compounds are prepared with carriers that will protect the compound against rapid elimination from the body, such as a controlled release formulation, including implants and microencapsulated delivery systems. Biodegradable, biocompatible polymers can be used, such as ethylene vinyl acetate, polyanhydrides, polyglycolic acid, collagen, polyorthoesters, and polylactic acid. Methods for preparation of such formulations will be apparent to those skilled in the art. The materials can also be obtained commercially from Alza Corporation and Nova Pharmaceuticals, Inc. Liposomal suspensions (including liposomes targeted to infected cells with monoclonal antibodies to specific receptors) can also be used as pharmaceutically acceptable carriers. These can be prepared according to methods known to those skilled in the art, for example, as described in U.S. Pat. No. 4,522,811.

A polynucleotide can be injected directly as naked DNA or RNA, by infection using defective or attenuated retrovirals or other viral vectors, or can be coated with lipids or cell-surface receptors or transfecting agents, encapsulated in liposomes, microparticles, or microcapsules, or by administering them in linkage to a peptide which is known to enter the nucleus, by administering it in linkage to a ligand subject to receptor-mediated endocytosis (see, e.g., Wu and Wu (1987) *J. Biol. Chem.* 262:4429-4432) (which can be used to target cell types specifically expressing the receptors) and so on. In another embodiment, polynucleotide-ligand complexes can be formed in which the ligand comprises a fusogenic viral peptide to disrupt endosomes, allowing the polynucleotide to avoid lysosomal degradation. In yet another embodiment, the polynucleotide can be targeted in vivo for cell specific uptake and expression, by targeting a specific receptor. Alternatively, the polynucleotide can be introduced intracellularly and incorporated within host cell DNA for expression, by homologous recombination (Koller and Smithies (1989) *Proc. Natl. Acad. Sci. USA* 86:8932-8935; Zijistra et al. (1989) *Nature* 342:435-438).

It is especially advantageous to formulate oral or parenteral compositions in dosage unit form for ease of administration and uniformity of dosage. Dosage unit form as used herein refers to physically discrete units suited as unitary dosages for the subject to be treated with each unit containing a predetermined quantity of active compound calculated to produce the desired therapeutic effect in association with the required pharmaceutical carrier. The specification for the dosage unit forms of the invention are dictated by and directly dependent on the unique characteristics of the active compound and the particular therapeutic effect to be achieved, and the limitations inherent in the art of compounding such an active compound for the treatment of individuals.

The pharmaceutical compositions can be included in a container, pack, or dispenser together with instructions for administration.

When administration is for the purpose of treatment, administration may be for either a prophylactic (i.e., preventative) or therapeutic purpose. When provided prophylactically, the substance is provided in advance of any symptom. The prophylactic administration of the substance serves to prevent or attenuate any subsequent symptom. When provided therapeutically, the substance is provided at (or shortly after) the onset of a symptom. The therapeutic administration of the substance serves to attenuate any actual symptom.

It will be understood by one of skill in the art that the treatment modalities described herein may be used alone or in conjunction with other therapeutic modalities (i.e., as adjuvant therapy), including, but not limited to, surgical therapy, radiotherapy, chemotherapy (e.g., with any chemotherapeutic agent well known in the art) or immunotherapy.

The skilled artisan will appreciate that certain factors may influence the dosage required to effectively treat a subject, including but not limited to the severity of the disease or disorder, previous treatments, the general health and/or age of the subject, and other diseases present. Moreover, treatment of a subject with a therapeutically effective amount of an ALK resistance mutant inhibitor can include a single treatment or, preferably, can include a series of treatments. It will also be appreciated that the effective dosage of an ALK resistance mutant inhibitor used for treatment may increase or decrease over the course of a particular treatment. Changes in dosage may result and become apparent from the results of diagnostic assays as described herein.

It is understood that appropriate doses of such active compounds depends upon a number of factors within the knowledge of the ordinarily skilled physician, veterinarian, or researcher. The dose(s) of the active compounds will vary, for example, depending upon the identity, size, and condition of the subject or sample being treated, further depending upon the route by which the composition is to be administered, if applicable, and the effect which the practitioner desires the active compound to have upon the ALK resistance mutant. Exemplary doses include milligram or microgram amounts of the small molecule per kilogram of subject or sample weight (e.g., about 1 microgram per kilogram to about 500 milligrams per kilogram, about 100 micrograms per kilogram to about 5 milligrams per kilogram, or about 1 microgram per kilogram to about 50 micrograms per kilogram. It is furthermore understood that appropriate doses of an active agent depend upon the potency of the active agent with respect to the expression or activity to be modulated. Such appropriate doses may be determined using the assays described herein. When one or more of these small molecules is to be administered to an animal (e.g., a human) in order to reduce the expression level or activity of an ALK resistance mutant, a physician, veterinarian, or researcher may, for example, prescribe a relatively low dose at first, subsequently increasing the dose until an appropriate response is obtained. In addition, it is understood that the specific dose level for any particular animal subject will depend upon a variety of factors including the activity of the specific compound employed, the age, body weight, general health, gender, and diet of the subject, the time of administration, the route of administration, the rate of excretion, any drug combination, and the degree of expression or activity to be modulated.

Therapeutically effective amounts of an ALK resistance mutant inhibitor can be determined by animal studies. When animal assays are used, a dosage is administered to provide a target tissue concentration similar to that which has been shown to be effective in the animal assays. It is recognized that the method of treatment may comprise a single administration of a therapeutically effective amount or multiple administrations of a therapeutically effective amount of the ALK resistance mutant inhibitor.

Any delivery system or treatment regimen that effectively achieves the desired effect of inhibiting cell growth can be used. Thus, for example, formulations comprising an effective amount of a pharmaceutical composition of the invention comprising ALK resistance mutant inhibitor or ALK resistance mutant specific binding agents can be used for the purpose of treatment, prevention, and diagnosis of a number of clinical indications related to the activity of the ALK resistance mutant.

It is to be noted that the term "a" or "an" entity refers to one or more of that entity; for example, "a polypeptide" is understood to represent one or more polypeptides. As such, the terms "a" (or "an"), "one or more," and "at least one" can be used interchangeably herein.

Throughout this specification and the embodiments, the words "comprise," "comprises," and "comprising" are used in a non-exclusive sense, except where the context requires otherwise.

As used herein, the term "about," when referring to a value is meant to encompass variations of, in some embodiments ±50%, in some embodiments ±20%, in some embodiments ±10%, in some embodiments ±5%, in some embodiments ±1%, in some embodiments ±0.5%, and in some embodiments ±0.1% from the specified amount, as such variations are appropriate to perform the disclosed methods or employ the disclosed compositions.

Further, when an amount, concentration, or other value or parameter is given as either a range, preferred range, or a list of upper preferable values and lower preferable values, this is to be understood as specifically disclosing all ranges formed from any pair of any upper range limit or preferred value and any lower range limit or preferred value, regardless of whether ranges are separately disclosed. Where a range of numerical values is recited herein, unless otherwise stated, the range is intended to include the endpoints thereof, and all integers and fractions within the range. It is not intended that the scope of the presently disclosed subject matter be limited to the specific values recited when defining a range.

Unless defined otherwise, all technical and scientific terms used herein have the same meaning as commonly understood by one of skill in the art to which the invention pertains. Although any methods and materials similar herein can be used in the practice or testing of the present invention, the preferred methods and materials are described herein.

The following examples are offered by way of illustration and not by way of limitation.

EXPERIMENTAL

Example 1

Identification and Characterization of Point Mutations of ALK that Confer Resistance to Small-Molecule Kinase Inhibitors The murine cell line BaF3 was stably transfected with a pcDNA3neo-NPM-ALK expression construct (the nucleotide and amino acid sequence of NPM-ALK is set forth in SEQ ID NO: 3 and 4, respectively). An NPM-ALK/BaF3 cell clone was isolated by limiting dilution for use in inhibitor-resistance screening. Screening for inhibitor-resistant colonies was performed as previously described with minor modifications including either intermittent or continuous exposures to the inhibitors (von Bubnoff et al. (2005) *Blood* 105:1652-1659; von Bubnoff et al. (2006) *Blood* 108:1328-1333; Kancha et al. (2009) *Clin Cancer Res* 15:460-467; von Bubnoff et al. (2009) *Cancer Res* 69:3032-3041; von Bubnoff et al. (2005) *Cell Cycle* 4:400-406). Briefly, NPM-ALK/BaF3 cells were cultured in 96-well plates at a density of $1\times10^5$ cells per well in the presence of various concentrations of the dual ALK/MET inhibitor PF-02341066 (Pfizer) or the ALK inhibitor compound NVP-TAE684 (Novartis) (Christensen et al. (2007) *Mol Cancer Ther* 6:3314-3322; McDermott et al. (2008) *Cancer Res* 68:3389-3395; Galkin et al. (2007) *Proc Natl Acad Sci USA* 104:270-275). Visible cell colonies were chosen, expanded, and sequence analysis was performed to identify the inhibitor-resistance mutations in the ALK kinase domain.

Table 2 lists each of the mutations that were identified. A total of eighteen (18) mutational exchanges at 13 different amino acid positions of the ALK kinase domain were identified. Each of the mutations was reconstructed in BaF3 cells by site-directed mutagenesis of wild-type (WT) NPM-ALK (SEQ ID NO: 4) and shown to confer resistance to PF-02341066 compared to BaF3 cells expressing WT NPM-ALK. Of note, all of the mutations identified by selection using NVP-TAE684 also conferred resistance to PF-02341066 (data not shown).

Cytotoxic $IC_{50}$ determinations for PF-02341066 were performed by a 72-hr XTT assay as previously described (Lagisetti et al. (2009) *J. Med. Chem.* 52:6979-6990) on the NPM-ALK/BaF3 cells containing each of the identified mutations to confirm unequivocally that the mutations confer inhibitor resistance. Representative results showing the level of resistance to cell death conferred by three of the ALK KD mutations identified are illustrated in FIG. 1. The $IC_{50}$ values for PF-02341066 is shown in Table 3. Each of the three mutations is associated with an $IC_{50}$ for PF-02341066 higher than that of normal parental BaF3, indicating that the concentrations of PF-02341066 required to efficiently kill tumor cells containing these mutations would likely be toxic to normal tissues.

TABLE 3

$IC_{50}$ value of PF-02341066 in parental BaF3 cells (none), or BaF3 cells expressing native (wild type) NPM-ALK or NPM-ALK with one of the identified inhibitor-resistance mutations.

| NPM-ALK | $IC_{50}$ (nm) |
|---|---|
| None | 1460 |
| Wild type | 460 |
| L1196M | 1960 |
| G1202R | 2060 |
| D1203N | 1490 |

TABLE 2

Mutations in the ALK kinase domain that when present in the NPM-ALK fusion protein confer resistance to inhibitor compounds PF-02341066 or NVP-TAE684.

| No. of Mutation | Amino acid Mutation* | Nucleotide Mutation | Inhibitor compound [concentration, nM] | Method of selection | Number of colonies |
|---|---|---|---|---|---|
| 1 | G1123S | GGC → AGC | PF-2341066 [850] | Continuous | 14 |
|   | G1123S | GGC → AGC | PF-2341066 [950] | Continuous | 2 |
|   | G1123S | GGC → AGC | PF-2341066 [1050] | Continuous | 1 |
|   | G1123S | GGC → AGC | NVP-TAE684 [88] | Continuous | 5 |
| 2 | G1123A | GGC → GCC | NVP-TAE684 [88] | Continuous | 5 |
| 3 | E1129V | GAG → GTG | PF-2341066 [910] | Continuous | 1 |
| 4 | E1132K | GAA → AAA | PF-2341066 [910] | Continuous | 1 |
| 5 | T1151M | ACG → ATG | PF-2341066 [850] | Continuous | 3 |
| 6 | C1156Y | TGC → TAC | PF-2341066 [910] | Continuous | 3 |
| 7 | F1174C | TTC → TGC | PF-2341066 [750] | Continuous | 2 |
|   | F1174C | TTC → TGC | NVP-TAE684 [88] | Continuous | 2 |
| 8 | F1174I | TTC → ATC | PF-2341066 [750] | Continuous | 1 |
|   | F1174I | TTC → ATC | NVP-TAE684 [88] | Continuous | 2 |
| 9 | F1174V | TTC → GTC | PF-2341066 [850] | Continuous | 1 |
| 10 | F1174L | TTC → CTC | PF-2341066 [850] | Continuous | 1 |
| 11 | L1196M | CTG → ATG | PF-2341066 [910] | Continuous | 2 |
| 12 | G1202R | GGA → AGA | PF-2341066 [750] | Continuous | 1 |
|   | G1202R | GGA → AGA | PF-2341066 [850] | Continuous | 43 |
|   | G1202R | GGA → AGA | PF-2341066 [950] | Continuous | 2 |
|   | G1202R | GGA → AGA | NVP-TAE684 [88] | Continuous | 2 |
| 13 | D1203N | GAC → AAC | PF-2341066 [525] | Intermittent | 1 |
|   | D1203N | GAC → AAC | PF-2341066 [750] | Continuous | 28 |
|   | D1203N | GAC → AAC | PF-2341066 [850] | Continuous | 40 |
|   | D1203N | GAC → AAC | PF-2341066 [950] | Continuous | 2 |
| 14 | E1210K | GAG → AAG | NVP-TAE684 [88] | Continuous | 1 |
| 15 | G1269A | GGA → GCA | PF-2341066 [850] | Continuous | 1 |
|   | G1269A | GGA → GCA | PF-2341066 [910] | Continuous | 1 |
|   | G1269A | GGA → GCA | PF-2341066 [1100] | Continuous | 6 |
| 16 | E1406K | GAA → AAA | PF-2341066 [850] | Continuous | 1 |
| 17 | E1408K | GAA → AAA | PF-2341066 [750] | Continuous | 1 |
|   | E1408K | GAA → AAA | PF-2341066 [910] | Continuous | 1 |
| 18 | E1406K/ E1408K | GAA → AAA/ GAA → AAA | PF-2341066 [850] | Continuous | 1 |

*The position of the amino acid residue is relative to the full-length ALK protein, the sequence of which is set forth in SEQ ID NO: 2.

SEQUENCE LISTING (135 sequences)

SEQ ID NO: 1 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 2 - protein, 1620 aa, Homo sapiens [sequence omitted]

SEQ ID NO: 3 - DNA, 2043 bp, Homo sapiens
  CDS (1)...(2043)
atggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtagtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 4 - protein, 680 aa, Homo sapiens
MEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLVVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 5 - DNA, 804 bp, Homo sapiens
  CDS (1)...(804)
atcaccctcattcggggtctgagccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggatt

SEQ ID NO: 6 - protein, 268 aa, Homo sapiens
ITLIRGLSHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERI

SEQ ID NO: 7 - DNA, 804 bp, Homo sapiens
  CDS (1)...(804)
atcaccctcattcggggtctggcccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggatt

SEQ ID NO: 8 - protein, 268 aa, Homo sapiens
ITLIRGLAHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERI

SEQ ID NO: 9 - DNA, 804 bp, Homo sapiens
  CDS (1)...(804)
atcaccctcattcggggtctgggccatggcgcctttggggtggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggatt

SEQ ID NO: 10 - protein, 268 aa, Homo sapiens
ITLIRGLGHGAFGVVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERI

SEQ ID NO: 11 - DNA, 804 bp, Homo sapiens
  CDS (1)...(804)
atcaccctcattcggggtctgggccatggcgcctttggggaggtgtataaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggatt

SEQ ID NO: 12 - protein, 268 aa, Homo sapiens
ITLIRGLGHGAFGEVYKGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERI

SEQ ID NO: 13 - DNA, 804 bp, Homo sapiens
  CDS (1)...(804)
atcaccctcattcggggtctgggccatggcgcctttggggaggtgtatgaaggccaggtgtccggaatgcccaacgacccaagccccctgcaagtggctgtgaagatgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggatt

SEQ ID NO: 14 - protein, 268 aa, Homo sapiens
ITLIRGLGHGAFGEVYEGQVSGMPNDPSPLQVAVKMLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERI

SEQ ID NO: 15 - DNA, 804 bp, Homo sapiens
  CDS (1)...(804)
atcaccctcattcggggtctgggccatggcgcctttggggaggtgtatgaaggccaggtgtccggaatgcccaacgacccaagccccctgcaagtggctgtgaagacgctgcctgaagtgtactctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggatt

SEQ ID NO: 16 - protein, 268 aa, Homo sapiens
ITLIRGLGHGAFGEVYEGQVSGMPNDPSPLQVAVKTLPEVYSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERI

SEQ ID NO: 17 - DNA, 804 bp, Homo sapiens
  CDS (1)...(804)
atcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaatgcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggatt

SEQ ID NO: 18 - protein, 268 aa, Homo sapiens
ITLIRGLGHGAFGEVYEGQVSGMPNDPSPLQVAVKTLPEVCSEQDELDFLMEALIISKCNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERI

SEQ ID NO: 19 - DNA, 804 bp, Homo sapiens
  CDS (1)...(804)
atcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaaatcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggatt

SEQ ID NO: 20 - protein, 268 aa, Homo sapiens
ITLIRGLGHGAFGEVYEGQVSGMPNDPSPLQVAVKTLPEVCSEQDELDFLMEALIISKINHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERI

SEQ ID NO: 21 - DNA, 804 bp, Homo sapiens
  CDS (1)...(804)
atcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaagtcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggatt

SEQ ID NO: 22 - protein, 268 aa, Homo sapiens
ITLIRGLGHGAFGEVYEGQVSGMPNDPSPLQVAVKTLPEVCSEQDELDFLMEALIISKVNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERI

SEQ ID NO: 23 - DNA, 804 bp, Homo sapiens
  CDS (1)...(804)
atcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgatggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggatt

SEQ ID NO: 24 - protein, 268 aa, Homo sapiens
ITLIRGLGHGAFGEVYEGQVSGMPNDPSPLQVAVKTLPEVCSEQDELDFLMEALIISKFNHQNIVRCIGVSLQSLPRFILMELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERI

SEQ ID NO: 25 - DNA, 804 bp, Homo sapiens
  CDS (1)...(804)
atcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggagagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggatt

SEQ ID NO: 26 - protein, 268 aa, Homo sapiens
ITLIRGLGHGAFGEVYEGQVSGMPNDPSPLQVAVKTLPEVCSEQDELDFLMEALIISKFNHQNIVRCIGVSLQSLPRFILLELMAGRDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERI

SEQ ID NO: 27 - DNA, 804 bp, Homo sapiens
  CDS (1)...(804)
atcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggaaacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggatt

SEQ ID NO: 28 - protein, 268 aa, Homo sapiens
ITLIRGLGHGAFGEVYEGQVSGMPNDPSPLQVAVKTLPEVCSEQDELDFLMEALIISKFNHQNIVRCIGVSLQSLPRFILLELMAGGNLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERI

SEQ ID NO: 29 - DNA, 804 bp, Homo sapiens
  CDS (1)...(804)
atcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgaaagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggatt

SEQ ID NO: 30 - protein, 268 aa, Homo sapiens
ITLIRGLGHGAFGEVYEGQVSGMPNDPSPLQVAVKTLPEVCSEQDELDFLMEALIISKFNHQNIVRCIGVSLQSLPRFILLELMAGGDLKSFLRKTRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERI

SEQ ID NO: 31 - DNA, 804 bp, Homo sapiens
  CDS (1)...(804)
atcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattgcagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggatt

SEQ ID NO: 32 - protein, 268 aa, Homo sapiens
ITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIADFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERI

SEQ ID NO: 33 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgagccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 34 - protein, 563 aa, Homo sapiens
VYRRKHQELQAMQMELQSPEYKLSKLRTSTIMTDYNPNYCFAGKTSSISDLKEVPRKNITLIRGLSHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 35 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctggcccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 36 - protein, 563 aa, Homo sapiens
VYRRKHQELQAMQMELQSPEYKLSKLRTSTIMTDYNPNYCFAGKTSSISDLKEVPRKNITLIRGLAHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 37 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggtggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 38 - protein, 563 aa, Homo sapiens
VYRRKHQELQAMQMELQSPEYKLSKLRTSTIMTDYNPNYCFAGKTSSISDLKEVPRKNITLIRGLGHGAFGVVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 39 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtataaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 40 - protein, 563 aa, Homo sapiens
VYRRKHQELQAMQMELQSPEYKLSKLRTSTIMTDYNPNYCFAGKTSSISDLKEVPRKNITLIRGLGHGAFGEVYKGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 41 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagatgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 42 - protein, 563 aa, Homo sapiens
VYRRKHQELQAMQMELQSPEYKLSKLRTSTIMTDYNPNYCFAGKTSSISDLKEVPRKNITLIRGLGHGAFGEVYEGQVSGMPNDPSPLQVAVKMLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 43 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtactctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 44 - protein, 563 aa, Homo sapiens
VYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVYSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 45 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaatgcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 46 - protein, 563 aa, Homo sapiens
VYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKCNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 47 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaaatcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 48 - protein, 563 aa, Homo sapiens
VYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKINHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 49 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaagtcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 50 - protein, 563 aa, Homo sapiens
VYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKVNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 51 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgatggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 52 - protein, 563 aa, Homo sapiens
VYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILMELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 53 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggagagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 54 - protein, 563 aa, Homo sapiens
VYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGRDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 55 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggaaacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 56 - protein, 563 aa, Homo sapiens
VYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGNLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 57 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgaaagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 58 - protein, 563 aa, Homo sapiens
VYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRKTRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 59 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattgcagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 60 - protein, 563 aa, Homo sapiens
VYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIADFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 61 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtgaaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 62 - protein, 563 aa, Homo sapiens
VYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVKEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 63 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagagaaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 64 - protein, 563 aa, Homo sapiens
VYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEKEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 65 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgagccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 66 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLSHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 67 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctggcccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 68 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLAHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 69 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggtggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 70 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGVVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 71 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtataaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 72 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYKGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 73 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagatgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 74 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKMLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 75 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtactctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 76 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVYSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 77 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaatgcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 78 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKCNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 79 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaaatcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 80 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKINHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 81 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaagtcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 82 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKVNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 83 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgatggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 84 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILMELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 85 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggagagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 86 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGRDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 87 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggaaacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 88 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGNLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 89 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgaaagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 90 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRKTRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 91 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattgcagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 92 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIADFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 93 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtgaaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 94 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVKEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 95 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagagaaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 96 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEKEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 97 - protein, 117 aa, Homo sapiens
MEDSMDMDMSPLRPQNYLFGCELKADKDYHFKVDNDENEHQLSLRTVSLGAGAKDELHIVEAEAMNYEGSPIKVTLATLKMSVQPTVSLGGFEITPPVVLRLKCGSGPVHISGQHLV

SEQ ID NO: 98 - DNA, 879 bp, Homo sapiens
  CDS (1)...(879)
atcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtgaaagaggaa

SEQ ID NO: 99 - protein, 293 aa, Homo sapiens
ITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVKEE

SEQ ID NO: 100 - DNA, 879 bp, Homo sapiens
  CDS (1)...(879)
atcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaattcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagagaaa

SEQ ID NO: 101 - protein, 293 aa, Homo sapiens
ITLIRGLGHGAFGEVYEGQVSGMPNDPSPLQVAVKTLPEVCSEQDELDFLMEALIISKFNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEK

SEQ ID NO: 102 - DNA, 879 bp, Homo sapiens
  CDS (1)...(879)
atcaccctcattcggggtctgggccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaactcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaa

SEQ ID NO: 103 - protein, 293 aa, Homo sapiens
ITLIRGLGHGAFGEVYEGQVSGMPNDPSPLQVAVKTLPEVCSEQDELDFLMEALIISKLNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEE

SEQ ID NO: 104 - DNA, 1692 bp, Homo sapiens
  CDS (1)...(1692)
gtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgagccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaactcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 105 - protein, 563 aa, Homo sapiens
VYRRKHQELQAMQMELQSPEYKLSKLRTSTIMTDYNPNYCFAGKTSSISDLKEVPRKNITLIRGLSHGAFGEVYEGQVSGMPNDPSPLQVAVKTLPEVCSEQDELDFLMEALIISKLNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 106 - DNA, 4863 bp, Homo sapiens
  CDS (1)...(4863)
atgggagccatcgggctcctgtggctgctgccgctgctgctttccacggcagctgtgggctccgggatggggaccggccagcgcgcgggctccccagctgcggggtcgccgctgcagccccgggagccactcagctactcgcgcctgcagaggaagagtctggcagttgacttcgtggtgccctcgctcttccgtgtctacgcccgggacctactgctgccaccatcctcctcggagctgaaggctggcaggcccgaggcccgcggctcgctagctctggactgcgccccgctgctcaggttgctggggccggcgccgggggtctcctggaccgccggttcaccagccccggcagaggcccggacgctgtccagggtgctgaagggcggctccgtgcgcaagctccggcgtgccaagcagttggtgctggagctgggcgaggaggcgatcttggagggttgcgtcgggccccccggggaggcggctgtggggctgctccagttcaatctcagcgagctgttcagttggtggattcgccaaggcgaagggcgactgaggatccgcctgatgcccgagaagaaggcgtcggaagtgggcagagagggaaggctgtccgcggcaattcgcgcctcccagccccgccttctcttccagatcttcgggactggtcatagctccttggaatcaccaacaaacatgccatctccttctcctgattattttacatggaatctcacctggataatgaaagactccttccctttcctgtctcatcgcagccgatatggtctggagtgcagctttgacttcccctgtgagctggagtattcccctccactgcatgacctcaggaaccagagctggtcctggcgccgcatcccctccgaggaggcctcccagatggacttgctggatgggcctggggcagagcgttctaaggagatgcccagaggctcctttctccttctcaacacctcagctgactccaagcacaccatcctgagtccgtggatgaggagcagcagtgagcactgcacactggccgtctcggtgcacaggcacctgcagccctctggaaggtacattgcccagctgctgccccacaacgaggctgcaagagagatcctcctgatgcccactccagggaagcatggttggacagtgctccagggaagaatcgggcgtccagacaacccatttcgagtggccctggaatacatctccagtggaaaccgcagcttgtctgcagtggacttctttgccctgaagaactgcagtgaaggaacatccccaggctccaagatggccctgcagagctccttcacttgttggaatgggacagtcctccagcttgggcaggcctgtgacttccaccaggactgtgcccagggagaagatgagagccagatgtgccggaaactgcctgtgggtttttactgcaactttgaagatggcttctgtggctggacccaaggcacactgtcaccccacactcctcagtggcaggtcaggaccctaaaggatgcccggttccaggaccaccaagaccatgctctattgctcagtaccactgatgtccccgcttctgaaagtgctacagtgaccagtgctacgtttcctgcaccgatcaagagctctccatgtgagctccgaatgtcctggctcattcgtggagtcttgaggggaaacgtgtccttggtgctagtggagaacaaaaccgggaaggagcaaggcaggatggtctggcatgtcgccgcctatgaaggcttgagcctgtggcagtggatggtgttgcctctcctcgatgtgtctgacaggttctggctgcagatggtcgcatggtggggacaaggatccagagccatcgtggcttttgacaatatctccatcagcctggactgctacctcaccattagcggagaggacaagatcctgcagaatacagcacccaaatcaagaaacctgtttgagagaaacccaaacaaggagctgaaacccggggaaaattcaccaagacagacccccatctttgaccctacagttcattggctgttcaccacatgtggggccagcgggccccatggccccacccaggcacagtgcaacaacgcctaccagaactccaacctgagcgtggaggtggggagcgagggccccctgaaaggcatccagatctggaaggtgccagccaccgacacctacagcatctcgggctacggagctgctggcgggaaaggcgggaagaacaccatgatgcggtcccacggcgtgtctgtgctgggcatcttcaacctggagaaggatgacatgctgtacatcctggttgggcagcagggagaggacgcctgccccagtacaaaccagttaatccagaaagtctgcattggagagaacaatgtgatagaagaagaaatccgtgtgaacagaagcgtgcatgagtgggcaggaggcggaggaggagggggtggagccacctacgtatttaagatgaaggatggagtgccggtgcccctgatcattgcagccggaggtggcggcagggcctacggggccaagacagacacgttccacccagagagactggagaataactcctcggttctagggctaaacggcaattccggagccgcaggtggtggaggtggctggaatgataacacttccttgctctgggccggaaaatctttgcaggagggtgccaccggaggacattcctgcccccaggccatgaagaagtgggggtgggagacaagagggggtttcggagggggtggaggggggtgctcctcaggtggaggaggcggaggatatataggcggcaatgcagcctcaaacaatgaccccgaaatggatggggaagatggggtttccttcatcagtccactgggcatcctgtacaccccagctttaaaagtgatggaaggccacggggaagtgaatattaagcattatctaaactgcagtcactgtgaggtagacgaatgtcacatggaccctgaaagccacaaggtcatctgcttctgtgaccacgggacggtgctggctgaggatggcgtctcctgcattgtgtcacccaccccggagccacacctgccactctcgctgatcctctctgtggtgacctctgccctcgtggccgccctggtcctggctttctccggcatcatgattgtgtaccgccggaagcaccaggagctgcaagccatgcagatggagctgcagagccctgagtacaagctgagcaagctccgcacctcgaccatcatgaccgactacaaccccaactactgctttgctggcaagacctcctccatcagtgacctgaaggaggtgccgcggaaaaacatcaccctcattcggggtctgagccatggcgcctttggggaggtgtatgaaggccaggtgtccggaatgcccaacgacccaagccccctgcaagtggctgtgaagacgctgcctgaagtgtgctctgaacaggacgaactggatttcctcatggaagccctgatcatcagcaaactcaaccaccagaacattgttcgctgcattggggtgagcctgcaatccctgccccggttcatcctgctggagctcatggcggggggagacctcaagtccttcctccgagagacccgccctcgcccgagccagccctcctccctggccatgctggaccttctgcacgtggctcgggacattgcctgtggctgtcagtatttggaggaaaaccacttcatccaccgagacattgctgccagaaactgcctcttgacctgtccaggccctggaagagtggccaagattggagacttcgggatggcccgagacatctacagggcgagctactatagaaagggaggctgtgccatgctgccagttaagtggatgcccccagaggccttcatggaaggaatattcacttctaaaacagacacatggtcctttggagtgctgctatgggaaatcttttctcttggatatatgccataccccagcaaaagcaaccaggaagttctggagtttgtcaccagtggaggccggatggacccacccaagaactgccctgggcctgtataccggataatgactcagtgctggcaacatcagcctgaagacaggcccaactttgccatcattttggagaggattgaatactgcacccaggacccggatgtaatcaacaccgctttgccgatagaatatggtccacttgtggaagaggaagagaaagtgcctgtgaggcccaaggaccctgagggggttcctcctctcctggtctctcaacaggcaaaacgggaggaggagcgcagcccagctgccccaccacctctgcctaccacctcctctggcaaggctgcaaagaaacccacagctgcagaggtctctgttcgagtccctagagggccggccgtggaagggggacacgtgaatatggcattctctcagtccaaccctccttcggagttgcacaaggtccacggatccagaaacaagcccaccagcttgtggaacccaacgtacggctcctggtttacagagaaacccaccaaaaagaataatcctatagcaaagaaggagccacacgacaggggtaacctggggctggagggaagctgtactgtcccacctaacgttgcaactgggagacttccgggggcctcactgctcctagagccctcttcgctgactgccaatatgaaggaggtacctctgttcaggctacgtcacttcccttgtgggaatgtcaattacggctaccagcaacagggcttgcccttagaagccgctactgcccctggagctggtcattacgaggataccattctgaaaagcaagaatagcatgaaccagcctgggccctga

SEQ ID NO: 107 - protein, 1620 aa, Homo sapiens
MGAIGLLWLLPLLLSTAAVGSGMGTGQRAGSPAAGSPLQPREPLSYSRLQRKSLAVDFVVPSLFRVYARDLLLPPSSSELKAGRPEARGSLALDCAPLLRLLGPAPGVSWTAGSPAPAEARTLSRVLKGGSVRKLRRAKQLVLELGEEAILEGCVGPPGEAAVGLLQFNLSELFSWWIRQGEGRLRIRLMPEKKASEVGREGRLSAAIRASQPRLLFQIFGTGHSSLESPTNMPSPSPDYFTWNLTWIMKDSFPFLSHRSRYGLECSFDFPCELEYSPPLHDLRNQSWSWRRIPSEEASQMDLLDGPGAERSKEMPRGSFLLLNTSADSKHTILSPWMRSSSEHCTLAVSVHRHLQPSGRYIAQLLPHNEAAREILLMPTPGKHGWTVLQGRIGRPDNPFRVALEYISSGNRSLSAVDFFALKNCSEGTSPGSKMALQSSFTCWNGTVLQLGQACDFHQDCAQGEDESQMCRKLPVGFYCNFEDGFCGWTQGTLSPHTPQWQVRTLKDARFQDHQDHALLLSTTDVPASESATVTSATFPAPIKSSPCELRMSWLIRGVLRGNVSLVLVENKTGKEQGRMVWHVAAYEGLSLWQWMVLPLLDVSDRFWLQMVAWWGQGSRAIVAFDNISISLDCYLTISGEDKILQNTAPKSRNLFERNPNKELKPGENSPRQTPIFDPTVHWLFTTCGASGPHGPTQAQCNNAYQNSNLSVEVGSEGPLKGIQIWKVPATDTYSISGYGAAGGKGGKNTMMRSHGVSVLGIFNLEKDDMLYILVGQQGEDACPSTNQLIQKVCIGENNVIEEEIRVNRSVHEWAGGGGGGGGATYVFKMKDGVPVPLIIAAGGGGRAYGAKTDTFHPERLENNSSVLGLNGNSGAAGGGGGWNDNTSLLWAGKSLQEGATGGHSCPQAMKKWGWETRGGFGGGGGGCSSGGGGGGYIGGNAASNNDPEMDGEDGVSFISPLGILYTPALKVMEGHGEVNIKHYLNCSHCEVDECHMDPESHKVICFCDHGTVLAEDGVSCIVSPTPEPHLPLSLILSVVTSALVAALVLAFSGIMIVYRRKHQELQAMQMELQSPEYKLSKLRTSTIMTDYNPNYCFAGKTSSISDLKEVPRKNITLIRGLSHGAFGEVYEGQVSGMPNDPSPLQVAVKTLPEVCSEQDELDFLMEALIISKLNHQNIVRCIGVSLQSLPRFILLELMAGGDLKSFLRETRPRPSQPSSLAMLDLLHVARDIACGCQYLEENHFIHRDIAARNCLLTCPGPGRVAKIGDFGMARDIYRASYYRKGGCAMLPVKWMPPEAFMEGIFTSKTDTWSFGVLLWEIFSLGYMPYPSKSNQEVLEFVTSGGRMDPPKNCPGPVYRIMTQCWQHQPEDRPNFAIILERIEYCTQDPDVINTALPIEYGPLVEEEEKVPVRPKDPEGVPPLLVSQQAKREEERSPAAPPPLPTTSSGKAAKKPTAAEVSVRVPRGPAVEGGHVNMAFSQSNPPSELHKVHGSRNKPTSLWNPTYGSWFTEKPTKKNNPIAKKEPHDRGNLGLEGSCTVPPNVATGRLPGASLLLEPSSLTANMKEVPLFRLRHFPCGNVNYGYQQQGLPLEAATAPGAGHYEDTILKSKNSMNQPGP

SEQ ID NO: 108 - DNA, 3516 bp, Homo sapiens
atggagtgtccttcgtgccagcatgtctccaaggaggaaacccccaagttctgcagccagtgcggagagaggctgcctcctgcagcccccatagcagattctgagaacaataactccacaatggcgtcggcctcggagggtgaaatggagtgtgggcaggagctgaaggaggaagggggcccgtgcttgttcccgggctcagacagttggcaagaaaaccccgaggagccctgttccaaagcctcctggaccgtccaagaaagcaaaaagaagaaaaggaagaagaaaaagaaggggaacaagtccgcttcctcagagctggcttccttgcccctttctcctgccagcccctgtcacctgactttgctttcaaacccatggcctcaggacacagccctgccccacagccaagcccagcagagtggccccactggccagccgagccagcccccgggcacagccaccacgccactggagggtgacggcctctccgcgcccaccgaggttggcgacagccccctgcaggcccaggctttgggagaggcaggagtggccacaggaagtgaggctcagagcagcccgcaattccaggaccacacggaaggggaggaccaggacgcttccatcccctctgggggcagaggcctgtcccaggaggggaccggtccccccacctctgctggtgaaggccattctaggactgaagatgctgcccaggagctcctgttgcctgagtcaaaaggaggcagctctgagcccgggacagaactgcagaccaccgagcaacaggcaggggcctcagcctctatggcagttgatgctgtagctgagccagccaatgcagttaaaggggccgggaaggaaatgaaagagaagacccagagaatgaaacagccaccagcaaccactcctcctttcaaaacacactgccaggaagctgagaccaagaccaaggacgagatggctgctgctgaagaaaaagtcggtaagaatgaacaaggggagcctgaagacctcaagaagccagaggggaagaacagaagtgcagctgctgtgaaaaacgagaaggagcaaaaaaaccaggaagcagatgtccaggaagtgaaggcaagcacgctgagcccgggtggaggagtcaccgtgttcttccacgccatcatctctcttcatttcccattcaatcctgacctccataaagtcttcatcagaggaggagaagaatttggggagtcaaaatgggacagcaatatctgtgagctgcactacaccagagacttgggtcatgaccgcgttcttgttgaaggattgtctgcatttccaagaagcacctagataaatacattccttacaagtacgtcatttataatggggaatcttttgagtatgagttcatttacaagcaccagcagaagaagggcgagtacgtcaaccgctgtctgttcataaaatcttcacttctgggctcaggagactggcatcagtactatgacatagtttatatgaagcctcatgggagactccagaaagtcatgaaccacatcacagacgggccgaggaaggacctggtgaaggggaagcagattgccgctgcgctcatgctggacagcaccttcagcatcctgcagacctgggacaccatcaacctgaacagcttcttcacccagttcgagcagttttgctttgtcctgcaacagcctatgatttatgaaggacaggcacagctgtggaccgatttgcagtacagggagaaagaggtgaagagatacctgtggcaacatctgaaaaaacacgtggtaccattgccggacggaaaaagcacggactttttgcctgtggactgcccagtgaggagtaaactgaaaacaggcctgattgtcctttttgtagtggaaaaaattgagcttttattagaaggcagcctggactggttgtgtcacctcctaacctcagatgccagctcaccagatgagtttcaccgtgacctaagccacatccttgggatacctcagagctggcggctgtacctggtgaacctgtgccaaagatgcatggacacaaggacgtacacctggctgggcgccctgcctgtcctgcactgctgtatggagctggccccgcggcacaaggatgcctggagacagcctgaggacacctgggccgctctggagggactctccttctcaccgttccgggaacaaatgctagatacgagttccctacttcagtttatgagagagaagcagcatttgctgagcatagacgagcctctcttccggtcctggtttagtctgctacctctgagtcacctggttatgtatatggaaaacttcattgagcacctgggtcgttttcctgctcatatcctggactgtctttcagggatttactaccggcttccgggacttgagcaagtcttgaatacgcaggatgttcaggatgttcagaacgttcagaacattttagaaatgctgttgcgactcctggacacttaccgggacaagattcccgaggaggccttgtcaccatcctacctgactgtgtgtctgaaactgcatgaagccatctgcagcagcacaaagctacttaagttttacgagctgccagccttatctgccgagattgtctgcagaatgattagacttctatctctggtggattctgcaggacagagagatgaaactggaaataattcagtccaaacagtcttccaagggacccttgctgctacgaaaaggtggctccgagaagtttttacaaagaacatgctcacatcttcaggtgcctcattcacatacgtcaaggaaattgaggtctggaggcggctggtggaaatccaattccccgcggagcatggctggaaggagtcgttgctgggagacatggaatggaggctcacaaaggaggaacccctctcccagatcactgcctactgcaatagttgctgggacaccaaaggcttagaggacagtgtggccaagaccttcgagaaatgcatcattgaagccgtgagctcagcctgccagtctcagaccagtatccttcaggggttctcttactctgatttgcggaaatttggcatcgtcttgtctgctgtgatcactaagtcctggcctaggaccgcggacaacttcgatgacattttaaagcatctgctcacgttggcagatgtcaagcacgtcttcagattgtgtggaaccgacgagaaaatactagcaaatgtcacagaggatgccaagaggctgatagctgttgccgactctgtgttgacgaaagttgttggtgacctcctaagtggcacgattttagttggacaactggagctgattataaagcacaagaatcagtttcttgacatctggcaactgagggaaaaaagtctttcaccccaggatgaaaaatgtgctgtggaggaagcactggattggagaagggaggaactgttacttctaaagaaagagaaaagatgtgttgatagtctcctgaagatgtgtgggaacgtgaaacatctgatacaag

SEQ ID NO: 109 - DNA, 688 bp, Homo sapiens
atggctcccggccagctcgccttatttagtgtctctgacaaaaccggccttgtggaatttgcaagaaacctgaccgctcttggtttgaatctggtcgcttccggagggactgcaaaagctctcagggatgctggtctggcagtcagagatgtctctgagttgacgggatttcctgaaatgttggggggacgtgtgaaaactttgcatcctgcagtccatgctggaatcctagctcgtaatattccagaagataatgctgacatggccagacttgatttcaatcttataagagttgttgcctgcaatctctatccctttgtaaagacagtggcttctccaggtgtaactgttgaggaggctgtggagcaaattgacattggtggagtaaccttactgagagctgcagccaaaaaccacgctcgagtgacagtggtgtgtgaaccagaggactatgtggtggtgtccacggagatgcagagctccgagagtaaggacacctccttggagactagacgccagttagccttgaaggcattcactcatacggcacaatatgatgaagcaatttcagattatttcaggaaacagtacagcaaaggcgtatctcagatgcccttgagatatggaatgaacccacatcagacccctgcccagctgtacacactgcagcccaagcttcccatcacag

SEQ ID NO: 110 - DNA, 2068 bp, Homo sapiens
atggcagattcctccgggcagcaggctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagcaaaggccggcgtgtgcagccccagtggtcccctcctgctgggacccagccatgcagactccacctttacaacagcctcaccaggaacaaggaagtgttcatacctcaagatgggaaaaaggtgacgtggtattgctgtgggccaaccgtctatgacgcatctcacatggggcacgccaggtcctacatctcttttgatatcttgagaagagtgttgaaggattacttcaaatttgatgtcttttattgcatgaacattacggatattgatgacaagatcatcaagagggcccggcagaaccacctgttcgagcagtatcgggagaagaggcctgaagcggcacagctcttggaggatgttcaggccgccctgaagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgttgctggaagaagccaaggatttgctctctgactggctggattctacacttggctgtgatgtcactgacaattccatcttctccaagctgcccaagttctgggagggggacttccacagagacatggaagctctgaatgttctccctccagatgtcttaacccgggttagtgagtatgtgccagaaattgtgaactttgtccagaagattgtggacaacggttacggctatgtctccaatgggtctgtctactttgatacagcgaagtttgcttctagcgagaagcactcctatgggaagctggtgcctgaggccgttggagatcagaaagcccttcaagaaggggaaggtgacctgagcatctctgcagaccgcctgagtgagaagcgctctcccaacgactttgccttatggaaggcctctaagcccggagaaccgtcctggccgtgcccttggggaaagggtcgtccgggctggcatatcgagtgctcggccatggcaggcaccctcctaggggcttcgatggacattcacggaggtgggttcgacctccggttcccccaccatgacaatgagctggcacagtcggaggcctactttgaaaacgactgctgggtcaggtacttcctgcacacaggccacctgaccattgcaggctgcaaaatgtcaaagtcactaaaaaacttcatcaccattaaagatgccttgaaaaagcactcagcacggcagttgcggctggccttcctcatgcactcgtggaaggacaccctggactactccagcaacaccatggagtcagcgcttcaatatgagaagttcttgaatgagtttttcttaaatgtgaaagatatccttcgcgctcctgttgacatcactggtcagtttgagaagtggggagaagaagaagcagaactgaataagaacttttatgacaagaagacagcaattcacaaagccctctgtgacaatgttgacacccgcaccgtcatggaagagatgcgggccttggtcagtcagtgcaacctctatatggcagcccggaaagccgtgaggaagaggcccaaccaggctctgctggagaacatcgccctgtacctcacccatatgctgaagatctttggggccgtagaagaggacagctccctgggattcccggtcggagggcctggaaccagcctcagtctcgaggccacagtcatgccctaccttcaggtgttatcagaattccgagaaggagtgcggaagattgcccgagagcaaaaag

SEQ ID NO: 111 - DNA, 4903 bp, Homo sapiens
atggcccagattctgccaattcgttttcaggagcatctccagctccagaacctgggtatcaacccagcaaacattggcttcagtaccctgactatggagtctgacaaattcatctgcattagagaaaaagtaggagagcaggcccaggtggtaatcattgatatgaatgacccaagtaatccaattcgaagaccaatttcagcagacagcgccatcatgaatccagctagcaaagtaattgcactgaaagctgggaaaactcttcagatttttaacattgaaatgaaaagtaaaatgaaggctcataccatgactgatgatgtcaccttttggaaatggatctctttgaatacggttgctcttgttacggataatgcagtttatcactggagtatggaaggagagtctcagccagtgaaaatgtttgatcgccattctagccttgcagggtgccagattatcaattaccgtacagatgcaaaacaaaagtggttacttctgactggtatatctgcacagcaaaatcgtgtggtgggagctatgcagctatattctgtagataggaaagtgtctcagcccattgaaggacatgcagctagctttgcacagtttaagatggaaggaaatgcagaagaatcaacgttattttgttttgcagttcggggccaagctggagggaagttacatattattgaagttggcacaccacctacagggaaccagccctttccaaagaaggcagtggatgtcttctttcctccagaagcacaaaatgattttcctgttgcaatgcagatcagtgaaaagcatgatgtggtgttcttgataaccaagtatggttatatccacctctatgatcttgagactggtacctgcatctacatgaatagaatcagtggagaaacaatttttgttactgcacctcatgaagccacagctggaataattggagtaaacagaaagggacaagttctgtcagtgtgtgtggaagaagaaaacataattccttacatcaccaatgttctacaaaatcctgatttggctctgagaatggctgtacgtaataacttagccggtgctgaagaactctttgcccggaaatttaatgctctttttgcccagggaaattactcggaggcagcaaaggtggctgctaatgcaccaaagggaattcttcgtactccagacactatccgtcggttccagagtgtcccagcccagccaggtcaaacttctcctctacttcagtactttggtatccttttggaccagggacagctcaacaaatacgaatccttagagctttgtaggcctgtacttcagcaagggcgaaaacagcttttggagaaatggttaaaagaagataagctggaatgttctgaagaactgggtgatcttgtgaaatctgtggaccctacattggcacttagtgtgtacctaagggctaacgtcccaaataaagtcattcagtgctttgcagaaacaggtcaagtccaaaagattgttttatatgctaaaaaagttggatacactccagattggatatttctgctgagaaatgtaatgcgaatcagtccagatcagggacagcagtttgcccaaatgttagttcaagatgaagagcctcttgctgacatcacacagattgtagatgtctttatggaatacaatctaattcagcagtgtactgcattcttgcttgatgctctgaagaataatcgcccatctgaaggtcctttacagacgcggttacttgagatgaaccttatgcatgcgcctcaagttgcagatgctattctaggcaatcagatgttcacacattatgaccgggctcatattgctcaactgtgtgaaaaggctggcctactgcagcgtgcattagaacatttcactgatttatatgatataaaacgtgcagtggttcacacccatcttcttaaccctgagtggttagtcaactactttggttccttatcagtagaagactccctagaatgtctcagagccatgctgtctgccaacatccgtcagaatctgcagatttgtgttcaggtggcttctaaatatcatgaacaactgtcaactcagtctctgattgaactttttgaatctttcaagagttttgaaggtctcttttattttctgggatccattgttaactttagccaggacccagatgtgcactttaaatatattcaggcagcttgcaagactgggcaaatcaaagaagtagaaagaatctgtagagaaagcaactgctacgatcctgagcgagtcaagaattttcttaaggaagcaaaactaacagatcagctaccacttatcattgtgtgtgatcgatttgactttgtccatgatttggtgctctatttatatagaaataatcttcaaaagtatatagagatatatgtacagaaggtgaatccaagtcgacttcctgtagttattggaggattacttgatgttgactgttctgaagatgtcataaaaaacttgattcttgttgtaagaggtcaattctctactgatgagcttgttgctgaggttgaaaaaagaaacagattgaaactgcttctgccttggctagaggccagaattcatgagggctgtgaggagcctgctactcacaatgccttagccaaaatctacatagacagtaataacaacccggagagatttcttcgtgaaaatccctactatgacagtcgcgttgttggaaagtattgtgagaagagagatccacatctggcctgtgttgcttatgaacgtggccaatgtgatctggaacttattaatgtttgcaatgagaattccctcttcaaaagtctttctcgctacctggtacgtcgaaaggatccagaattgtggggcagcgtgctgctggaaagcaatccttacaggagacccctaattgaccaggttgtacaaacagctttgtctgagactcaggaccctgaagaagtgtcagtaactgtaaaggctttcatgactgcagaccttcctaatgaactcattgaactgctggagaaaattgtccttgataactctgtattcagtgaacacaggaatctgcaaaacctccttatcctcactgcaattaaggctgaccgtacacgtgttatggagtatattaaccgcctggataattatgatgccccagatattgccaatatcgccatcagcaatgagctgtttgaagaagcatttgccattttccggaaatttgatgtcaatacttcagcagttcaggtcttaattgagcatattggaaacttggatcgggcatatgagtttgctgaacgttgcaatgaacctgcggtctggagtcaacttgcaaaagcccagttgcagaaaggaatggtgaaagaagccattgattcttatatcaaagcagatgatccttcctcctacatggaagttgttcaggctgccaatactagtggaaactgggaagaactggtgaagtacttgcagatggcccgtaagaaggctcgagagtcctatgtggagacagaactgatattcgcactggctaaaacaaaccgccttgcagagttagaagaatttatcaatggaccaaataatgctcatatccaacaagttggtgaccgttgttatgatgaaaaaatgtatgatgctgctaagttgttgtacaataatgtttccaattttggacgtttggcatctaccctggttcacctgggtgaatatcaggcagctgttgatggggctaggaaagctaacagtactcgaacatggaaagaggtctgcttcgcctgtgtagatgggaaagaattccgtcttgctcagatgtgtggacttcatattgttgtacatgcagatgaattagaagaacttatcaactactatcaggatcgtggctattttgaagagctgatcaccatgttggaagcagcactgggacttgagcgagctcacatgggaatgtttactgaattagctattctatactctaaatttaagcctcagaaaatgagggagcacctggagctgttctggtctagagtgaatattcccaaggtgctaagagctgcagaacaagctcatctttgggcagaactggtgtttttgtatgacaagtatgaagaatatgataatgccataattaccatgatgaatcatccaactgatgcctggaaagaagggcaattcaaagatatcattaccaaggttgccaatgtggaactatactacagagcaatacagttctacttagaattcaagcctctgttgttaaatgatttgctgatggtgctgtctccacggttggatcacactcgtgcagtcaattatttcagcaaggttaaacagctaccactggtgaaaccgtatttgcgttcagttcagaaccataacaacaaatctgtgaatgaatcattgaacaatctttttattacagaagaagattatcaggctctgcgaacatcaatagatgcttatgacaactttgacaatatctcgcttgctcagcgtttggaaaaacatgaactcattgagttcaggagaattgctgcttatctcttcaaaggcaacaatcgctggaaacagagtgtagagctgtgcaagaaagacagcctttacaaggatgcaatgcagtatgcttctgaatctaaagatactgaattggctgaagaactcctgcagtggtttttgcaggaagaaaaaagagagtgctttggagcttgtctgtttacctgttacgatcttttaaggccagatgtcgtcctagaaactgcatggaggcacaatatcatggattttgccatgccctatttcatccaggtcatgaaggagtacttgacaaaggtggataaattagatgcttcagaatcactgagaaaagaagaagaacaagctacagagacacaacccattgtttatg

SEQ ID NO: 112 - DNA, 1489 bp, Homo sapiens
atggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaag

SEQ ID NO: 113 - DNA, 2242 bp, Homo sapiens
atggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatagatggtaccttcctggctgtaggatctcatgacaactttatttacctctatgtagtctctgaaaatggaagaaaatatagcagatatggaaggtgcactggacattccagctacatcacacaccttgactggtccccagacaacaagtatataatgtctaactcgggagactatgaaatattgtact

SEQ ID NO: 114 - DNA, 667 bp, Homo sapiens
atggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaag

SEQ ID NO: 115 - DNA, 700 bp, Homo sapiens
atggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagcaaaaatgtcaactcgcgaaaaaaacagccaag

SEQ ID NO: 116 - DNA, 1652 bp, Homo sapiens
atggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaggaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagagatatgctggat

SEQ ID NO: 117 - DNA, 2056 bp, Homo sapiens
atggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaagaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagaggttcctgatcagtatggcacaatcagagctgtagcagaaggaaaggcagatcaatttttagtaggcacatcacgaaactttattttacgaggaacatttaatgatggcttccaaatagaagtacagggtcatacagatgagctttggggtcttgccacacatcccttcaaagatttgctcttgacatgtgctcaggacaggcaggtgtgcctgtggaactcaatggaacacaggctggaatggaccaggctggtagatgaaccaggacactgtgcagattttcatccaagtggcacagtggtggccataggaacgcactcaggcaggtggtttgttctggatgcagaaaccagagatctagtttctatccacacagacgggaatgaacagctctctgtgatgcgctactcaatag

SEQ ID NO: 118 - DNA, 208 bp, Homo sapiens
atggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaag

SEQ ID NO: 119 - DNA, 325 bp, Homo sapiens
atggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggttcagagctcaggggaggatatggagatccagggaggcttcctgtaggaagtggcctgtgtagtgcttcaagggccaggctgccaggccatgttgcagctgaccacccacctgcag

SEQ ID NO: 120 - DNA, 1489 bp, Homo sapiens
atggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaggaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaag

SEQ ID NO: 121 - DNA, 1641 bp, Homo sapiens
atggacggtttcgccggcagtctcgatgatagtatttctgctgcaagtacttctgatgttcaagatcgcctgtcagctcttgagtcacgagttcagcaacaagaagatgaaatcactgtgctaaaggcggctttggctgatgttttgaggcgtcttgcaatctctgaagatcatgtggcctcagtgaaaaaatcagtctcaagtaaaggccaaccaagccctcgagcagttattcccatgtcctgtataaccaatggaagtggtgcaaacagaaaaccaagtcataccagtgctgtctcaattgcaggaaaagaaactctttcatctgctgctaaaagtggtacagaaaaaaagaaagaaaaaccacaaggacagagagaaaaaaaagaggaatctcattctaatgatcaaagtccacaaattcgagcatcaccttctccccagccctcttcacaacctctccaaatacacagacaaactccagaaagcaagaatgctactcccaccaaaagcataaaacgaccatcaccagctgaaaagtcacataattcttgggaaaattcagatgatagccgtaataaattgtcgaaaataccttcaacacccaaattaataccaaaagttaccaaaactgcagacaagcataaagatgtcatcatcaaccaagaaggagaatatattaaaatgtttatgcgcggtcggccaattaccatgttcattccttccgatgttgacaactatgatgacatcagaacggaactgcctcctgagaagctcaaactggagtgggcatatggttatcgaggaaaggactgtagagctaatgtttaccttcttccgaccggggaaatagtttatttcattgcatcagtagtagtactatttaattatgaggagagaactcagcgacactacctgggccatacagactgtgtgaaatgccttgctatacatcctgacaaaattaggattgcaactggacagatagctggcgtggataaagatggaaggcctctacaaccccacgtcagagtgtgggattctgttactctatccacactgcagattattggacttggcacttttgagcgtggagtaggatgcctggatttttcaaaagcagattcaggtgttcatttatgtgttattgatgactccaatgagcatatgcttactgtatgggactggcagaggaaagcaaaaggagcagaaataaagacaacaaatgaagttgttttggctgtggagtttcacccaacagatgcaaataccataattacatgcggtaaatctcatattttcttctggacctggagcggcaattcactaacaagaaaacagggaatttttgggaaatatgaaaagccaaaatttgtgcagtgtttagcattcttggggaatggagatgttcttactggagactcaggtggagtcatgcttatatggagcaaaactactgtagagcccacacctgggaaaggacctaaaggtgtatatcaaatcagcaaacaaatcaaagctcatgatggcagtgtgttcacactttgtcagatgagaaatgggatgttattaactggaggagggaaagacagaaaaataattctgtgggatcatgatctgaatcctgaaagagaaatagag

SEQ ID NO: 122 - DNA, 2761 bp, Homo sapiens
atggcggacctggccgagtgcaacatcaaagtgatgtgtcgcttcagacctctcaacgagtctgaagtgaaccgcggcgacaagtacatcgccaagtttcagggagaagacacggtcgtgatcgcgtccaagccttatgcatttgatcgggtgttccagtcaagcacatctcaagagcaagtgtataatgactgtgcaaagaagattgttaaagatgtacttgaaggatataatggaacaatatttgcatatggacaaacatcctctgggaagacacacacaatggagggtaaacttcatgatccagaaggcatgggaattattccaagaatagtgcaagatatttttaattatatttactccatggatgaaaatttggaatttcatattaaggtttcatattttgaaatatatttggataagataagggacctgttagatgtttcaaagaccaacctttcagttcatgaagacaaaaaccgagttccctatgtaaaggggtgcacagagcgttttgtatgtagtccagatgaagttatggataccatagatgaaggaaaatccaacagacatgtagcagttacaaatatgaatgaacatagctctaggagtcacagtatatttcttattaatgtcaaacaagagaacacacaaacggaacaaaagctgagtggaaaactttatctggttgatttagctggtagtgaaaaggttagtaaaactggagctgaaggtgctgtgctggatgaagctaaaaacatcaacaagtcactttctgctcttggaaatgttatttctgctttggctgagggtagtacatatgttccatatcgagatagtaaaatgacaagaatccttcaagattcattaggtggcaactgtagaaccactattgtaatttgctgctctccatcatcatacaatgagtctgaaacaaaatctacactcttatttggccaaagggccaaaacaattaagaacacagtttgtgtcaatgtggagttaactgcagaacagtggaaaaagaagtatgaaaaagaaaaagaaaaaaataagatcctgcggaacactattcagtggcttgaaaatgagctcaacagatggcgtaatggggagacggtgcctattgatgaacagtttgacaaagagaaagccaacttggaagctttcacagtggataaagatattactcttaccaatgataaaccagcaaccgcaattggagttataggaaattttactgatgctgaaagaagaaagtgtgaagaagaaattgctaaattatacaaacagcttgatgacaaggatgaagaaattaaccagcaaagtcaactggtagagaaactgaagacgcaaatgttggatcaggaggagcttttggcatctaccagaagggatcaagacaatatgcaagctgagctgaatcgccttcaagcagaaaatgatgcctctaaagaagaagtgaaagaagttttacaggccctagaagaacttgctgtcaattatgatcagaagtctcaggaagttgaagacaaaactaaggaatatgaattgcttagtgatgaattgaatcagaaatcggcaactttagcgagtatagatgctgagcttcagaaacttaaggaaatgaccaaccaccagaaaaaacgagcagctgagatgatggcatctttactaaaagaccttgcagaaataggaattgctgtgggaaataatgatgtaaagcagcctgagggaactggcatgatagatgaagagttcactgttgcaagactctacattagcaaaatgaagtcagaagtaaaaaccatggtgaaacgttgcaagcagttagaaagcacacaaactgagagcaacaaaaaaatggaagaaaatgaaaaggagttagcagcatgtcagcttcgtatctctcaacatgaagccaaaatcaagtcattgactgaataccttcaaaatgtggaacaaaagaaaagacagttggaggaatctgtcgatgccctcagtgaagaactagtccagcttcgagcacaagagaaagtccatgaaatggaaaaggagcacttaaataaggttcagactgcaaatgaagttaagcaagctgttgaacagcagatccagagccatagagaaactcatcaaaaacagatcagtagtttgagagatgaagtagaagcaaaagcaaaacttattactgatcttcaagaccaaaaccagaaaatgatgttagagcaggaacgtctaagagtagaacatgagaagttgaaagccacagatcaggaaaagagcagaaaactacatgaacttacggttatgcaagatagacgagaacaagcaagacaagacttgaagggtttggaagagacagtggcaaaagaacttcagactttacacaacctgcgcaaactctttgttcaggacctggctacaagagttaaaaagagtgctgagattgattctgatgacaccggaggcagcgctgctcagaagcaaaaaatctcctttcttgaaaataatcttgaacagctcactaaagtgcacaaacagttggtacgtgataatgcagatctccgctgtgaacttcctaagttggaaaagcgacttcgagctacagctgagagagtgaaagctttggaatcagcactgaaagaagctaaagaaaatgcatctcgtgatcgcaaacgctatcagcaagaagtagatcgcataaaggaagcagtcaggtcaaagaatatggccagaagagggcattctgcacagattg

SEQ ID NO: 123 - DNA, 1344 bp, Homo sapiens
atgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaag

SEQ ID NO: 124 - DNA, 1400 bp, Homo sapiens
atgcccaaaacgatcagtgtgcgtgtgaccaccatggatgcagagctggagtttgccatccagcccaacaccaccgggaagcagctatttgaccaggtggtgaaaactattggcttgagggaagtttggttctttggtctgcagtaccaggacactaaaggtttctccacctggctgaaactcaataagaaggtgactgcccaggatgtgcggaaggaaagccccctgctctttaagttccgtgccaagttctaccctgaggatgtgtccgaggaattgattcaggacatcactcagcgcctgttctttctgcaagtgaaagagggcattctcaatgatgatatttactgcccgcctgagaccgctgtgctgctggcctcgtatgctgtccagtctaagtatggcgacttcaataaggaagtgcataagtctggctacctggccggagacaagttgctcccgcagagagtcctggaacagcacaaactcaacaaggaccagtgggaggagcggatccaggtgtggcatgaggaacaccgtggcatgctcagggaggatgctgtcctggaatatctgaagattgctcaagatctggagatgtatggtgtgaactacttcagcatcaagaacaagaaaggctcagagctgtggctgggggtggatgccctgggtctcaacatctatgagcagaatgacagactaactcccaagataggcttcccctggagtgaaatcaggaacatctctttcaatgataagaaatttgtcatcaagcccattgacaaaaaagccccggacttcgtcttctatgctccccggctgcggattaacaagcggatcttggccttgtgcatggggaaccatgaactatacatgcgccgtcgcaagcctgataccattgaggtgcagcagatgaaggcacaggcccgggaggagaagcaccagaagcagatggagcgtgctatgctggaaaatgagaagaagaagcgtgaaatggcagagaaggagaaagagaagattgaacgggagaaggaggagctgatggagaggctgaagcagatcgaggaacagactaagaaggctcagcaagaactggaagaacagacccgtagggctctggaacttgagcaggaacggaagcgtgcccagagcgaggctgaaaagctggccaaggagcgtcaagaagctgaagaggccaaggaggccttgctgcaggcctcccgggaccagaaaaagactcaggaacagctggccttggaaatggcagagctgacagctcgaatctcccagctggagatggcccgacagaagaaggagagtgaggctgtggagtggcagcagaagcaggcagcatgggagaaggcactcatggtttcgtcaaatacttactggagttctct

SEQ ID NO: 125 - DNA, 4934 bp, Homo sapiens
atggcacagcaagctgccgataagtatctctatgtggataaaaacttcatcaacaatccgctggcccaggccgactgggctgccaagaagctggtatgggtgccttccgacaagagtggctttgagccagccagcctcaaggaggaggtgggcgaagaggccatcgtggagctggtggagaatgggaagaaggtgaaggtgaacaaggatgacatccagaagatgaacccgcccaagttctccaaggtggaggacatggcagagctcacgtgcctcaacgaagcctcggtgctgcacaacctcaaggagcgttactactcagggctcatctacacctattcaggcctgttctgtgtggtcatcaatccttacaagaacctgcccatctactctgaagagattgtggaaatgtacaagggcaagaagaggcacgagatgccccctcacatctatgccatcacagacaccgcctacaggagtatgatgcaagaccgagaagatcaatccatcttgtgcactggtgaatctggagctggcaagacggagaacaccaagaaggtcatccagtatctggcgtacgtggcgtcctcgcacaagagcaagaaggaccagggcgagctggagcggcagctgctgcaggccaaccccatcctggaggccttcgggaacgccaagaccgtgaagaatgacaactcctcccgcttcggcaaattcattcgcatcaactttgatgtcaatggctacattgttggagccaacattgagacttatcttttggagaaatctcgtgctatccgccaagccaaggaagaacggaccttccacatcttctattatctcctgtctggggctggagagcacctgaagaccgatctcctgttggagccgtacaacaaataccgcttcctgtccaatggacacgtcaccatccccgggcagcaggacaaggacatgttccaggagaccatggaggccatgaggattatgggcatcccagaagaggagcaaatgggcctgctgcgggtcatctcaggggttcttcagctcggcaacatcgtcttcaagaaggagcggaacactgaccaggcgtccatgcccgacaacacagctgcccaaaaggtgtcccatctcttgggtatcaatgtgaccgatttcaccagaggaatcctcaccccgcgcatcaaggtgggacgggattacgtccagaaggcgcagactaaagagcaggctgactttgccatcgaggccttggccaaggcgacctatgagcggatgttccgctggctggtgctgcgcatcaacaaggctctggacaagaccaagaggcagggcgcctccttcatcgggatcctggacattgccggcttcgagatctttgatctgaactcgtttgagcagctgtgcatcaattacaccaatgagaagctgcagcagctcttcaaccacaccatgttcatcctggagcaggaggagtaccagcgcgagggcatcgagtggaacttcatcgactttggcctcgacctgcagccctgcatcgacctcattgagaagccagcaggccccccgggcattctggccctgctggacgaggagtgctggttccccaaagccaccgacaagagcttcgtggagaaggtgatgcaggagcagggcacccaccccaagttccagaagcccaagcagctgaaggacaaagctgatttctgcattatccactatgccggcaaggtggattacaaagctgacgagtggctgatgaagaacatggatcccctgaatgacaacatcgccacactgctccaccagtcctctgacaagtttgtctcggagctgtggaaggatgtggaccgcatcatcggcctggaccaggtggccggcatgtcggagaccgcactgcccggggccttcaagacgcggaagggcatgttccgcactgtggggcagctttacaaggagcagctggccaagctgatggctacgctgaggaacacgaaccccaactttgtccgctgcatcatccccaaccacgagaagaaggccggcaagctggacccgcatctcgtgctggaccagctgcgctgcaacggtgttctcgagggcatccgtatctgccgccagggcttccccaacagggtggtcttccaggagtttcggcagagatatgagatcctgactccaaactccattcccaagggtttcatggacgggaagcaggcgtgcgtgctcatgataaaagccctggagctcgacagcaatctgtaccgcattggccagagcaaagtcttcttccgtgccggtgtgctggcccacctggaggaggagcgagacctgaagatcaccgacgtcatcatagggttccaggcctgctgcaggggctacctggccaggaaagcatttgccaagcggcagcagcagcttaccgccatgaaggtcctccagcggaactgcgctgcctacctgaagctgcggaactggcagtggtggcggctcttcaccaaggtcaagccgctgctgcaggtgagccggcaggaggaggagatgatggccaaggaggaggagctggtgaaggtcagagagaagcagctggctgcggagaacaggctcacggagatggagacgctgcagtctcagctcatggcagagaaattgcagctgcaggagcagctccaggcagaaaccgagctgtgtgccgaggctgaggagctccgggcccgcctgaccgccaagaagcaggaattagaagagatctgccatgacctagaggccagggtggaggaggaggaggagcgctgccagcacctgcaggcggagaagaagaagatgcagcagaacatccaggagcttgaggagcagctggaggaggaggagagcgcccggcagaagctgcagctggagaaggtgaccaccgaggcgaagctgaaaaagctggaggaggagcagatcatcctggaggaccagaactgcaagctggccaaggaaaagaaactgctggaagacagaatagctgagttcaccaccaacctcacagaagaggaggagaaatctaagagcctcgccaagctcaagaacaagcatgaggcaatgatcactgacttggaagagcgcctccgcagggaggagaagcagcgacaggagctggagaagacccgccggaagctggagggagactccacagacctcagcgaccagatcgccgagctccaggcccagatcgcggagctcaagatgcagctggccaagaaagaggaggagctccaggccgccctggccagagtggaagaggaagctgcccagaagaacatggccctcaagaagatccgggagctggaatctcagatctctgaactccaggaagacctggagtctgagcgtgcttccaggaataaagctgagaagcagaaacgggaccttggggaagagctagaggctctgaaaacagagttggaggacacgctggattccacagctgcccagcaggagctcaggtcaaaacgtgagcaggaggtgaacatcctgaagaagaccctggaggaggaggccaagacccacgaggcccagatccaggagatgaggcagaagcactcacaggccgtggaggagctggcggagcagctggagcagacgaagcgggtgaaagcaaacctcgagaaggcaaagcagactctggagaacgagcggggggagctggccaacgaggtgaaggtgctgctgcagggcaaaggggactcggagcacaagcgcaagaaagtggaggcgcagctgcaggagctgcaggtcaagttcaacgagggagagcgcgtgcgcacagagctggccgacaaggtcaccaagctgcaggtggagctggacaacgtgaccgggcttctcagccagtccgacagcaagtccagcaagctcaccaaggacttctccgcgctggagtcccagctgcaggacactcaggagctgctgcaggaggagaaccggcagaagctgagcctgagcaccaagctcaagcaggtggaggacgagaagaattccttccgggagcagctggaggaggaggaggaggccaagcacaacctggagaagcagatcgccaccctccatgcccaggtggccgacatgaaaaagaagatggaggacagtgtggggtgcctggaaactgctgaggaggtgaagaggaagctccagaaggacctggagggcctgagccagcggcacgaggagaaggtggccgcctacgacaagctggagaagaccaagacgcggctgcagcaggagctggacgacctgctggtggacctggaccaccagcgccagagcgcgtgcaacctggagaagaagcagaagaagtttgaccagctcctggcggaggagaagaccatctctgccaagtatgcagaggagcgcgaccgggctgaggcggaggcccgagagaaggagaccaaggctctgtcgctggcccgggccctggaggaagccatggagcagaaggcggagctggagcggctcaacaagcagttccgcacggagatggaggaccttatgagctccaaggatgatgtgggcaagagtgtccacgagctggagaagtccaagcgggccctagagcagcaggtggaggagatgaagacgcagctggaagagctggaggacgagctgcaggccaccgaagatgccaagctgcggttggaggtcaacctgcaggccatgaaggcccagttcgagcgggacctgcagggccgggacgagcagagcgaggagaagaagaagcagctggtcagacaggtgcgggagatggaggcagagctggaggacgagaggaagcagcgctcgatggcagtggccgcccggaagaagctggagatggacctgaaggacctggaggcgcacatcgactcggccaacaagaaccgggacgaagccatcaaacagctgcggaagctgcaggt

SEQ ID NO: 126 - DNA, 352 bp, Homo sapiens
atggaagattcgatggacatggacatgagccccctgaggccccagaactatcttttcggttgtgaactaaaggccgacaaagattatcactttaaggtggataatgatgaaaatgagcaccagttatctttaagaacggtcagtttaggggctggtgcaaaggatgagttgcacattgttgaagcagaggcaatgaattacgaaggcagtccaattaaagtaacactggcaactttgaaaatgtctgtacagccaacggtttcccttgggggctttgaaataacaccaccagtggtcttaaggttgaagtgtggttcagggccagtgcatattagtggacagcacttagtag

SEQ ID NO: 127 - DNA, 2602 bp, Homo sapiens
atgaggcgcagcaaggctgacgtggagcggtacatcgcctcggtgcagggctccaccccgtcgcctcgacagaagtcaatgaaaggattctattttgcaaagctgtattatgaagctaaagaatatgatcttgctaaaaaatacatatgtacttacattaatgtgcaagagagggatcccaaagctcacagatttctgggtcttctttatgaattggaagaaaacacagacaaagccgttgaatgttacaggcgttcagtggaattaaacccaacacaaaaagatcttgtgttgaagattgcagaattgctttgtaaaaatgatgttactgatggaagagcaaaatactggcttgaaagagcagccaaacttttcccaggaagtcctgcaatttataaactaaaggaacagcttctagattgtgaaggtgaagatggatggaataaactttttgacttgattcagtcagaactttatgtaagacctgatgacgtccatgtgaacatccggctagtggaggtgtatcgctcaactaaaagattgaaggatgctgtggcccactgccatgaggcagagaggaacatagctttgcgttcaagtttagaatggaattcgtgtgttgtacagacccttaaggaatatctggagtctttacagtgtttggagtctgataaaagtgactggcgagcaaccaatacagacttactgctggcctatgctaatcttatgcttcttacgctttccactagagatgtgcaggaaagtagagaattactgcaaagttttgatagtgctcttcagtctgtgaaatctttgggtggaaatgatgaactgtcagctactttcttagaaatgaaaggacatttctacatgcatgctggttctctgcttttgaagatgggtcagcatagtagtaatgttcaatggcgagctctttctgagctggctgcattgtgctatctcatagcatttcaggttccaagaccaaagattaaattaataaaaggtgaagctggacaaaatctgctggaaatgatggcctgtgaccgactgagccaatcagggcacatgttgctaaacttaagtcgtggcaagcaagattttttaaaagagattgttgaaacttttgccaacaaaagcgggcagtctgcattatatgatgctctgttttctagtcagtcacctaaggatacatcttttcttggtagcgatgatattggaaacattgatgtacgagaaccagagcttgaagatttgactagatacgatgttggtgctattcgagcacataatggtagtcttcagcaccttacttggcttggcttacagtggaattcattgcctgctttacctggaatccgaaaatggctaaaacagcttttccatcatttgccccatgaaacctcaaggcttgaaacaaatgcacctgaatcaatatgtattttagatcttgaagtatttctccttggagtagtatataccagccacttacaattaaaggagaaatgtaattctcaccacagctcctatcagccgttatgcctgccccttcctgtgtgtaaacagctttgtacagaaagacaaaaatcttggtgggatgcggtttgtactctgattcacagaaaagcagtacctggaaacgtagcaaaattgagacttctagttcagcatgaaataaacactctaagagcccaggaaaaacatggccttcaacctgctctgcttgtacattgggcagaatgccttcagaaaacgggcagcggtcttaattctttttatgatcaacgagaatacatagggagaagtgttcattattggaagaaagttttgccattgttgaagataataaaaaagaagaacagtattcctgaacctattgatcctctgtttaaacattttcatagtgtagacattcaggcatcagaaattgttgaatatgaagaagacgcacacataacttttgctatattggatgcagtaaatggaaatatagaagatgctgtgactgcttttgaatctataaaaagtgttgtttcttattggaatcttgcactgatttttcacaggaaggcagaagacattgaaaatgatgccctttctcctgaagaacaagaagaatgcaaaaattatctgagaaagaccagggactacctaataaagattatagatgacagtgattcaaatctttcagtggtcaagaaattgcctgtgcccctggagtctgtaaaagagatgcttaattcagtcatgcaggaactcgaagactatagtgaaggaggtcctctctataaaaatggttctttgcgaaatgcagattcagaaataaaacattctacaccgtctcctaccagatattcactatcaccaagtaaaagttacaagtattctcccaaaacaccacctcgatgggcagaagatcagaattctttactgaaaatgatttgccaacaagtagaggccattaagaaagaaatgcaggagttgaaactaaatagcagtaactcagcatcccctcatcgttggcccacagagaattatggaccagactcagtgcctgatggatatcaggggtcacagacatttcatggggctccactaacag

SEQ ID NO: 128 - DNA, 2968 bp, Homo sapiens
atgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggaagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagccttatcaaccagcccagccgtatcccttcggaacaggggggtcagcaatgtatcgacctcagcagcctgttgctcctcctacttcaaacgcttaccctaacaccccttacatatcttctgcttcttcctatactgggcagtctcagctgtacgcagcacagcaccaggcctcttcacctacctccagccctgctacttctttccctcctcccccttcctctggagcatccttccagcatggcggaccaggagctccaccatcatcttcagcttatgcactgcctcctggaacaacaggtacactgcctgctgccagtgagctgcctgcgtcccaaagaacag

SEQ ID NO: 129 - DNA, 2626 bp, Homo sapiens
atgaagttaaaggaagtagatcgtacagccatgcaggcatggagccctgcccagaatcaccccatttacctagcaacaggaacatctgctcagcaattggatgcaacatttagtacgaatgcttcccttgagatatttgaattagacctctctgatccatccttggatatgaaatcttgtgccacattctcctcttctcacaggtaccacaagttgatttgggggccttataaaatggattccaaaggagatgtctctggagttctgattgcaggtggtgaaaatggaaatattattctctatgatccttctaaaattatagctggagacaaggaagttgtgattgcccagaatgacaagcatactggcccagtgagagccttggatgtgaacattttccagactaatctggtagcttctggtgctaatgaatctgaaatctacatatgggatctaaataattttgcaaccccaatgacaccaggagccaaaacacagccgccagaagatatcagctgcattgcatggaacagacaagttcagcatattttagcatcagccagtcccagtggccgggccactgtatgggatcttagaaaaaatgagccaatcatcaaagtcagtgaccatagtaacagaatgcattgttctgggttggcatggcatcctgatgttgctactcagatggtccttgcctccgaggatgaccggttaccagtgatccagatgtgggatcttcgatttgcttcctctccacttcgtgtcctggaaaaccatgccagggggattttggcaattgcttggagcatggcagatcctgaattgttactgagctgtggaaaagatgctaagattctctgctccaatccaaacacaggagaggtgttatatgaacttcccaccaacacacagtggtgcttcgatattcagtggtgtccccgaaatcctgctgtcttatcagctgcttcgtttgatgggcgtatcagtgtttattctatcatgggaggaagcacagatggtttaagacagaaacaagttgacaagctttcatcatcttttgggaatcttgatccctttggcacaggacagccccttcctccgttacaaattccacagcagactgctcagcatagtatagtgctgcctctgaagaagccgcccaagtggattcgaaggcctgttggtgcttctttttcatttggaggcaaactggttacgtttgagaatgtcagaatgccttctcatcagggagctgagcagcagcagcagcagcaccatgtgttcattagtcaggttgtaacagaaaaggagttcctcagccgatcagaccaacttcagcaggctgtgcagtcacaaggatttatcaattattgccaaaaaaaaattgatgcttctcagactgaatttgagaaaaatgtgtggtcctttttgaaggtaaactttgaggatgattctcgtggaaaataccttgaacttctaggatacagaaaagaagatctaggaaagaagattgctttggccttgaacaaagtggatggagccaatgtggctcttaaagactctgaccaagtagcacagagtgatggggaggagagccctgctgctgaagagcagctcttgggagagcacattaaagaggaaaaagaagaatctgaatttctaccctcatctggaggaacatttaatatctctgtcagtggggacattgatggtttaattactcaggctttgctgacgggcaattttgagagtgctgttgacctttgtttacatgataaccgcatggccgatgccattatattggccatagcaggtggacaagaactcttggctcgaacccagaaaaaatacttcgcaaaatcccaaagcaaaattaccaggctcatcactgcagtggtgatgaagaactggaaagagattgttgagtcttgtgatcttaaaaattggagagaggctttagctgcagtattgacttatgcaaagccggatgaattttcagccctttgtgatcttttgggaaccaggcttgaaaatgaaggagatagcctcctgcagactcaagcatgtctctgctatatttgtgcagggaatgtagagaaattagttgcatgttggactaaagctcaagatggaagccaccctttgtcacttcaggatctgattgagaaagttgtcatcctgcgaaaagctgtgcaactcactcaagccatggacactagtactgtaggagttctcttggctgcgaagatgagtcagtatgccaatttgttggcagctcagggcagtattgctgcagccttggcttttcttcctgacaacaccaaccagccaaatatcatgcagcttcgtgacagactttgtagagcacaaggagagcctgtagcaggacatgaatcacctaaaattccgtacgagaaacagcagctccccaagggcaggcctggaccagttgctggccaccaccagatgccaagagttcaaactcaacaatattatccccatggagaaaatcctccacctccgggtttcataatgcatggaaatgttaatccaaatgctgctggtcagcttcccacatctccaggtcatatgcacacccaggtaccaccttatccacagccacagc

SEQ ID NO: 130 - DNA, 415 bp, Homo sapiens
atgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatg

SEQ ID NO: 131 - DNA, 580 bp, Homo sapiens
atgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcag

SEQ ID NO: 132 - DNA, 721 bp, Homo sapiens
atgaacggacagttggatctaagtgggaagctaatcatcaaagctcaacttggggaggatattcggcgaattcctattcataatgaagatattacttatgatgaattagtgctaatgatgcaacgagttttcagaggaaaacttctgagtaatgatgaagtaacaataaagtataaagatgaagatggagatcttataacaatttttgatagttctgacctttcctttgcaattcagtgcagtaggatactgaaactgacattatttgttaatggccagccaagaccccttgaatcaagtcaggtgaaatatctccgtcgagaactgatagaacttcgaaataaagtgaatcgtttattggatagcttggaaccacctggagaaccaggaccttccaccaatattcctgaaaatgatactgtggatggtagggaagaaaagtctgcttctgattcttctggaaaacagtctactcaggttatggcagcaagtatgtctgcttttgatcctttaaaaaaccaagatgaaatcaataaaaatgttatgtcagcgtttggcttaacagatgatcaggtttcagggccacccagtgctcctgcagaagatcgttcaggaacacccgacagcattgcttcctcctcctcagcagctcacccaccaggcgttcagccacagcagccaccatatacaggagctcagactcaagcaggtcagattgaag

SEQ ID NO: 133 - DNA, 775 bp, Homo sapiens
atgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaagggacagaggatgagctggacaagtattctgaagctttgaaggatgcccaggagaagctggaactggcagagaagaaggctgctgatgctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaag

SEQ ID NO: 134 - DNA, 394 bp, Homo sapiens
atgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaag

SEQ ID NO: 135 - DNA, 664 bp, Homo sapiens
atggccggcctcaactccctggaggcggtgaaacgcaagatccaggccctgcagcagcaggcggacgaggcggaagaccgcgcgcagggcctgcagcgggagctggacggcgagcgcgagcggcgcgagaaagctgaaggtgatgtggccgccctcaaccgacgcatccagctcgttgaggaggagttggacagggctcaggaacgactggccacggccctgcagaagctggaggaggcagaaaaagctgcagatgagagtgagagaggaatgaaggtgatagaaaaccgggccatgaaggatgaggagaagatggagattcaggagatgcagctcaaagaggccaagcacattgcggaagaggctgaccgcaaatacgaggaggtagctcgtaagctggtcatcctggagggtgagctggagagggcagaggagcgtgcggaggtgtctgaactaaaatgtggtgacctggaagaagaactcaagaatgttactaacaatctgaaatctctggaggctgcatctgaaaagtattctgaaaaggaggacaaatatgaagaagaaattaaacttctgtctgacaaactgaaagaggctgagacccgtgctgaatttgcagagagaacggttgcaaaactggaaaagacaattgatgacctggaag

That which is claimed:

1. An isolated polynucleotide comprising the nucleotide sequence as set forth in SEQ ID NO: 104 which encodes the polypeptide set forth in SEQ ID NO: 105.

2. The isolated polynucleotide of claim 1, wherein said polynucleotide further comprises a nucleotide sequence encoding an ALK oncogenic fusion protein partner, and wherein said polynucleotide encodes an ALK oncogenic fusion protein.

3. The isolated polynucleotide of claim 2, wherein said ALK oncogenic fusion protein partner is selected from the group consisting of nucleophosmin (NPM), non-muscle tropomyosin 3 (TPM3), 5-aminoimidazole-4-carboxamide ribonucleotide formyltransferase/IMP cyclohydrolase (ATIC), clathrin heavy chain (CLTC), TRK-fused gene (TFG), non-muscle tropomyosin 4 (TPM4), moesin (MSN), Ran-binding protein 2 (RanBP2), echinoderm microtubule-associated protein-like 4 (EML4), cysteinyl-tRNA synthetase (CARS), kinesin family member 5B (KIF5B), non-muscle myosin heavy chain 9 (MYH9), SEC31 homolog A (SEC31L1), and ring finger protein 213 (RNF213)/ALK lymphoma oligomerization partner on chromosome 17 (ALO17).

4. The isolated polynucleotide of claim 1, wherein the polypeptide encoded by the polynucleotide has kinase activity that is resistant to at least one ALK small-molecule kinase inhibitor, and wherein said ALK small-molecule kinase inhibitor is PF-02341066.

5. An expression cassette comprising the isolated polynucleotide of claim 1 operably linked to a promoter.

6. An isolated host cell comprising the expression cassette of claim 5.

* * * * *